United States Patent 11,931,406 (FLAVIVIRUS VACCINE) - sequence listing, part 33

SEQ ID NO: 13120 - RNA, 9867 nt, Artificial Sequence
  derived and/or modified CDS sequence (opt2) from DENV-4__KU513441__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagcgcgucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13121 - RNA, 9867 nt, Artificial Sequence
  derived and/or modified CDS sequence (opt2) from DENV-4__KC762694__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccucccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacgucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaaguacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13122 - RNA, 9867 nt, Artificial Sequence
  derived and/or modified CDS sequence (opt2) from DENV-4__KC762695__SS-prME
uccaccaugacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacuccuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcaacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccauccaccaggucuucggcuccgucuacaccaccauguucggcggcgucuccuggaugauccgcauccucaucggccuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuuccucgaggucgaggacuacggcuucggcauguucuccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaucgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucaccaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacgacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgucgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaucggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucgaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaucucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucucccagguccgcaaccucaucggcaaggaggaguacgucgacuacaugcccgucaugaagcgcuacuccgcccccuccgaguccgagggcguccucuga

SEQ ID NO: 13123 - RNA, 9867 nt, Artificial Sequence
  derived and/or modified CDS sequence (opt2) from DENV-4__KC762696__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucaucauccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacgucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaaguacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccccgacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13124 - RNA, 9867 nt, Artificial Sequence
  derived and/or modified CDS sequence (opt2) from DENV-4__KC762697__SS-prME
uccaccaugacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggccuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcguccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucuccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaucgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgccaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacgacacccaggucggcacccucgcccucucccucaccuucauccgcuccaccaccccccucgucauggccuggcgcaccaucauggccgucuucuucauggucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaggccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggccaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaaguacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucgaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13125 - RNA, 9867 nt, Artificial Sequence
  derived and/or modified CDS sequence (opt2) from DENV-4__KC762698__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgucugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgccggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacgucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaacaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaaguacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccgcgaggagcacaaggagaccuggcacuacgaccacgagaaccccuaccgcaccugggccuaccacggcuccuacgaggcccccuccaccggcuccgccuccuccauggucaacggcaucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucgagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggcuccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13126 - RNA, 9867 nt, Artificial Sequence
  derived and/or modified CDS sequence (opt2) from DENV-4__KC762699__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgagcucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacgucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaaguacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13127 - RNA, 9867 nt, Artificial Sequence
  derived and/or modified CDS sequence (opt2) from DENV-4__JQ915085__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaucauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccugggucgaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccgcgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggucgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccauccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccgccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13128 - RNA, 9867 nt, Artificial Sequence
  derived and/or modified CDS sequence (opt2) from DENV-4__JQ915088__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuccacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucaugcgcuccaccaccccccucgucauggccuggcgcaccaucauggccgucuucuucgucaucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccauggccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccucccccuccgaguccgagggcguccucuga

SEQ ID NO: 13129 - RNA, 9867 nt, Artificial Sequence
  derived and/or modified CDS sequence (opt2) from DENV-4__JQ915086__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcguccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucaucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13130 - RNA, 9867 nt, Artificial Sequence
  derived and/or modified CDS sequence (opt2) from DENV-4__JQ915087__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucaucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccacucccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13131 - RNA, 9867 nt, Artificial Sequence
  derived and/or modified CDS sequence (opt2) from DENV-4__JQ915089__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcguccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucaucacccucaucccccucugccgcaccuccugccuccagaagcagucccacugggucgagaucaccgcccucauccucggcgcccaggcccuccccgucuaccucaugacccucaugaagggcgccuccucccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgagaucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13132 - RNA, 9867 nt, Artificial Sequence
  derived and/or modified CDS sequence (opt2) from DENV-4__JQ915082__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucaucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacauguccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggaccccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13133 - RNA, 9867 nt, Artificial Sequence
  derived and/or modified CDS sequence (opt2) from DENV-4__JQ915081__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucaucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacauguccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaucgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggaccccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13134 - RNA, 9867 nt, Artificial Sequence
  derived and/or modified CDS sequence (opt2) from DENV-4__JQ915084__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucaugcgcuccaccaccccccucgucauggccuggcgcaccaucauggccgucuucuucgucaucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucgccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagaucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccucccccuccgaguccgagggcguccucuga

SEQ ID NO: 13135 - RNA, 9867 nt, Artificial Sequence
  derived and/or modified CDS sequence (opt2) from DENV-4__KM190936__SS-prME
uccaccaucacccuccucugccucauccccaccgucauggccuucucccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaugaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13136 - RNA, 9867 nt, Artificial Sequence
  derived and/or modified CDS sequence (opt2) from DENV-4__JQ915090__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucgccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagauccccaucgagauccgcgacgucaacaaggagaaggucgucggccgcaucaucuccuccacccccuucgccgagaacaccaacuccgucaucaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaagauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucaugaccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucaugcgcuccaccaccccccucgucauggccuggcgcaccaucauggccgucuucuucgucaucacccucaucccccucugccgcaccuccugccuccagaagcagucccacugggucgagaugaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcuccgacaugaucuccuacggcggcggcuggcgccucggcgacaagugggacaaggaggaggacguccagguccucgccaucgagcccggcaagaacccccgccacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaccacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacauguccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucauccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaucaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcauccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcucggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccaucgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacgucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccagcaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccucccccuccgaguccgagggcguccucuga

SEQ ID NO: 13137 - RNA, 9867 nt, Artificial Sequence
  derived and/or modified CDS sequence (opt2) from DENV-4__KJ160504__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucggcaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcgucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccgccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucuggaucgccgagauccagccccaguggaucgccgccuccaucauccucgaguucuuccucaugguccuccucauccccgagcccgagaagcagcgcaccccccaggacaaccagcucaucuacgucauccucaccguccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccguccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcucuucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13138 - RNA, 9867 nt, Artificial Sequence
  derived and/or modified CDS sequence (opt2) from DENV-4__GU289913__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaugaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcucuccguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13139 - RNA, 9867 nt, Artificial Sequence
  derived and/or modified CDS sequence (opt2) from DENV-4__KJ579243__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcugccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccggccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13140 - RNA, 9867 nt, Artificial Sequence
  derived and/or modified CDS sequence (opt2) from DENV-4__KJ579246__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccauccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13141 - RNA, 9867 nt, Artificial Sequence
  derived and/or modified CDS sequence (opt2) from DENV-4__KJ579248__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcgucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13142 - RNA, 9867 nt, Artificial Sequence
  derived and/or modified CDS sequence (opt2) from DENV-4__KJ579240__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccgucaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13143 - RNA, 9867 nt, Artificial Sequence
  derived and/or modified CDS sequence (opt2) from DENV-4__KJ596658__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13144 - RNA, 9867 nt, Artificial Sequence
  derived and/or modified CDS sequence (opt2) from DENV-4__KJ596659__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13145 - RNA, 9867 nt, Artificial Sequence
  derived and/or modified CDS sequence (opt2) from DENV-4__KJ596661__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacaucgagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccacccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaaggcccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13146 - RNA, 9867 nt, Artificial Sequence
  derived and/or modified CDS sequence (opt2) from DENV-4__KJ596663__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagacccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13147 - RNA, 9867 nt, Artificial Sequence
  derived and/or modified CDS sequence (opt2) from DENV-4__KJ596664__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggaaccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13148 - RNA, 9867 nt, Artificial Sequence
  derived and/or modified CDS sequence (opt2) from DENV-4__KJ596665__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccggccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgagaacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13149 - RNA, 9867 nt, Artificial Sequence
  derived and/or modified CDS sequence (opt2) from DENV-4__KJ596668__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgaguacggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13150 - RNA, 9867 nt, Artificial Sequence
  derived and/or modified CDS sequence (opt2) from DENV-4__KJ596670__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucguccucggcggccucaccuggauggaccuccuccgcgcccucaucaugcucggcgacaccauguccggccgcaucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccagaucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13151 - RNA, 9867 nt, Artificial Sequence
  derived and/or modified CDS sequence (opt2) from DENV-4__KJ596671__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13152 - RNA, 9867 nt, Artificial Sequence
  derived and/or modified CDS sequence (opt2) from DENV-4__KJ579241__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaagaucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcaccaugcgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13153 - RNA, 9867 nt, Artificial Sequence
  derived and/or modified CDS sequence (opt2) from DENV-4__KJ596672__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucaucgccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccaucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaucgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacauguccgucaugaagcgcuacuccgcccccuccgaguccgagggcguccucuga

SEQ ID NO: 13154 - RNA, 9867 nt, Artificial Sequence
  derived and/or modified CDS sequence (opt2) from DENV-4__KJ579242__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucauccucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgucuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcaccaugcgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13155 - RNA, 9867 nt, Artificial Sequence
  derived and/or modified CDS sequence (opt2) from DENV-4__GQ398256__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccagaacggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgccgucaccguccacaacggcgacacccacgccgucggcaacgacaccuccucccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgaguccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugguccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgucggccccuggcaccucggcaagcucgagaucgacuucggcgagugccccggcaccaccgucgccauccgcgaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuuccuccgcuccaccaucccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugaagcgcggcgaccuccccgucuggcucuccuacaaggucgccuccgccggcaucuccuacaaggaccgcgaguggugcuucaccggcgagcgcaacaaccagauccucgaggagaacauggaggucgagaucuggaccaaggagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaucggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccgccaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgcuacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccgucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcaucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucaacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagcaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaccgagugcggcgucgaccgccucaagcgcauggccaucuccggcgacgacugcgucgucaagccccucgacgagcgcuucuccgccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13156 - RNA, 9867 nt, Artificial Sequence
  derived and/or modified CDS sequence (opt2) from DENV-4__KC333651__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccagaacggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguuccucugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgaguccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugguccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgucggccccuggcaccucggcaagcucgagaucgacuucggcgagugccccggcaccaccgucgccauccgcgaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuuccuccgcuccaccaucccccucgucauggccuggcgcaccaucauggccgucuucuucgucgucacccucaucccccucugccgcaccuccugccuccagaagcacucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccuccuccucgagaaggccgccaacguccagugggacgagauggccgacaucaccggcuccucccccaucaucgaggucaagcaggacgaggacggcuccuucuccauccgcgacgucgaggagaccaacaugaugacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugaagcgcggcgaccuccccgucuggcucuccuacaaggucgccuccgccggcaucuccuacaaggaccgcgaguggugcuucaccggcgagcgcaacaaccagauccucgaggagaacauggaggucgagaucuggaccaaggagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaucggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggcccucugcgagguccucacccucgccaccggccccgccaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgcuacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccgucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaugaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagcaggagggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaccgagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggacuacgucgacuacaugcccgucaugaagcgcuacuccgcccccuccgaguccgagggcguccucuga

SEQ ID NO: 13157 - RNA, 9867 nt, Artificial Sequence
  derived and/or modified CDS sequence (opt2) from DENV-4__JN559740__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccgcgccgucggcaacgacaucuccaaccacggcgucaccgccaugaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccucaagcccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaucacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacguccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13158 - RNA, 9867 nt, Artificial Sequence
  derived and/or modified CDS sequence (opt2) from DENV-4__JN559741__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccgccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13159 - RNA, 9867 nt, Artificial Sequence
  derived and/or modified CDS sequence (opt2) from DENV-4__JQ513334__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccauggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccgagaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucgagcuccccgacuacggcgagcucacccucgacugcgagccccgcuccggcaucgacuucaacgagaugauccucaugaagaugaagaagaagaccuggcucguccacaagcagugguuccucgaccucccccuccccugggccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaucccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcgucgccauccucggcgagaccgccugggacuucggcuccgucggcggccucuucaccucccucggcaaggccguccaccaggucuucggcuccgucuacaccaccauguucggcggcgucuccuggaugguccgcauccucaucggccuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucgccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13160 - RNA, 9867 nt, Artificial Sequence
  derived and/or modified CDS sequence (opt2) from DENV-4__JQ513336__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccgagaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucgagcuccccgacuacggcgagcucacccucgacugcgagccccgcuccggcaucgacuucaacgagaugauccucaugaagaugaagaagaagaccuggcucguccacaagcagugguuccucgaccucccccuccccugggccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaucccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugguccgcauccucaucggccuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucgccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13161 - RNA, 9867 nt, Artificial Sequence
  derived and/or modified CDS sequence (opt2) from DENV-4__JQ513338__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggagcagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcaacacccccgccgucggcaacgacaccuccaaccacggcgucaccgcccccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacgagaaccacauguucgccggccaccucaagugcaagguccgcaugggcaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgaccgcuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucaucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13162 - RNA, 9867 nt, Artificial Sequence
  derived and/or modified CDS sequence (opt2) from DENV-4__JQ513339__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggccaccuucaaggucccccacgccaagcgccaggacgucacccuccucggcucccaggagggcgccaugcacuccgcccucgccggcgccaccgaggucgacuccggcgacgagaaccacauguucgccggccaccucaagugcaagguccgcaugggcaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcguccucuccgccaccccccucgccgagaacaccaacuccgucaccaacaucgagcucgagccccccuucggcgacuccuacaucgucaucggcgucggcaacuccgcccucacccuccacugguucaccaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucaucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13163 - RNA, 9867 nt, Artificial Sequence
  derived and/or modified CDS sequence (opt2) from DENV-4__JQ513343__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggagaccuucaaggucccccacgccaagcgccaggacgucacccuccucggcucccaggagggcgccaugcacuccgcccucgccggcgccaccgaggucgacuccggcgacgagaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucaucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13164 - RNA, 9867 nt, Artificial Sequence
  derived and/or modified CDS sequence (opt2) from DENV-4__KT276273__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggccgccccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucgagcuccccgacuacggcgagcucacccucgacugcgagccccgcuccggcaucgacuucaacgagaugauccucaugaagaugaacaagaagaccuggcucguccacaagcagugguuccucgaccucccccuccccuggaccgccggcgccgacaccuccgagguccacuggaacaacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucaucggccgcgucaucuccuccaucccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucaucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgagaugugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaucgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccauccccuacgaccucauggagcucaucgacggcaucucccucggccucauccuccucaagaucgucacccaguucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcaccaaggaggaguucaucuccaagguccgcgccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucgccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccucaaggagaccgccugccucgccaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacauggacuacaugcccgucaugcgccgcuacuccgcccccuccgaguccgagggcguccucuga

SEQ ID NO: 13165 - RNA, 9867 nt, Artificial Sequence
  derived and/or modified CDS sequence (opt2) from DENV-4__KU523872__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggcccacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccuggaacggcaaggagcucaagugcggcaacggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccugggucgaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuucauccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccgucaucgaggucaagcaggacgaggacggcuccuucuccauccgcgacgucgaggagaccaacaugaucacccuccucgucaagcucgcccucaucaccgucuccggccucuacccccucgccauccccgucaccauggccaucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggaagcucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcuccaucgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccacccuccccaccuaccucuccuccaaggccaagcucgcccucgacaacaucgucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucgucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaucggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggcccucugcgagguccucacccucgccaccggccccaucaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccuccgcgacggcuccaagaccaagcacgccgucucccgcggcuccuccaagauccgcuggaucgucgagcgcggcaugaucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggcaagacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgcuaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcaagaucaugaccaccaccgccaacuggcucugggcccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggccgcugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccgagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugaagcgcuacuccgcccccuucgaguccgagggcguccucuga

SEQ ID NO: 13166 - RNA, 9867 nt, Artificial Sequence
  derived and/or modified CDS sequence (opt2) from DENV-4__KP140942__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggccgccccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucgagcuccccgacuacggcgagcucacccucgacugcgagccccgcuccggcaucgacuucaacgagaugauccucaugaagaugaacaagaagaccuggcucguccacaagcagugguuccucgaccucccccuccccuggaccgccggcgccgacaccuccgagguccacuggaacaacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucaucggccgcgucaucuccuccaucccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucaucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgagaugugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaucgccggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucgccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaugggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaagucccucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcaccaaggaggaguucaucuccaagguccgcgccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucgccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccucaaggagaccgccugccucgccaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacauggacuacaugcccgucaugcgccgcuacuccgcccccuccgaguccgagggcguccucuga

SEQ ID NO: 13167 - RNA, 9867 nt, Artificial Sequence
  derived and/or modified CDS sequence (opt2) from DENV-4__KU523871__SS-prME
uccaccaugacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccagaacggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaucgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgaguccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugguccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucacccgcggcaagcgcgcccucaccccccccgucaacgaccucaaguacuccuggaagaccuggggcaaggccaagaucuucacccccgaggcccgcaacuccaccuuccucaucgacggccccgacaccuccgagugccccaacgagcgccgcgccuggaacuucuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucaucccccgcuccuacgccggccccuucucccagcacaacuaccgccagggcuacgccacccagaccgucggccccuggcaccucggcaagcucgagaucgacuucggcgagugccccggcaccaccgucgccauccgcgaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggccaccgccggccagggcaccuccgagaccuucuccaugggccuccucugccucacccucuucgucgaggagugccuccgccgccgcgucacccgcaagcacaugauccucgucgucgucaucaccuucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccgucuucuccaucccccacgaccucauggagcucaucgacggcaucucccucggccucauccuccucaagaucgucacccacuucgacaacacccaggucggcacccucgcccucucccucaccuuccuccgcuccaccaccccccucgucauggccuggcgcaccaucauggccgucuucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaugacccuccucgucaagcucgcccucaucaccgucuccggccucuacccccucgccauccccgucaccauggcccucugguacaucuggcaggucaagacccagcgcuccggcgcccucugggacguccccucccccgccgccacccagaaggccacccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaacaagaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccugcuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagcgcgucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugaagcgcggcgaccuccccgucuggcucuccuacaaggucgccuccgccggcaucuccuacaaggaccgcgaguggugcuucaccggcgagcgcaacaaccagauccucgaggagaacauggaggucgagaucuggaccaaggagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccuccaaggccaagcucgcccucgacaacaucaucaugcuccacaccaccgagaagggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaucggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggcccucugcgagguccucacccucgccaccggccccgccaugacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgccuccggcaacaucgucuccuccgucaacaccaucuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccgcgaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccgcaugaucaugaccaccaccgccaacuggcucuggacccuccucggcaagaagaaguccccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaugugguacauguggcucggcgcccgcuuccucgaguucgaggcccucggcuuccucaacgaggaccacugguucucccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagacccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaccgagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccgucuacuccugggaggacauccccuaccucggcaagcgcgaggaccucuggugcggcucccucaucggccucuccucccgcgccaccugggccaagaacauccacaccgccaucacccagguccgcaaccucaucggcaaggaggacuacgucgacuacaugcccaucaugaagcgcuacuccgcccccuccgaguccgagggcguccucuga

SEQ ID NO: 13168 - RNA, 9867 nt, Artificial Sequence
  derived and/or modified CDS sequence (opt2) from DENV-4__HQ332175__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgucgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucgcccagguccgcaaccucaucggcaaggaggaguacgucgacuacaugcccgucaugaagcgcuacuccgcccccuccgaguccgagggcguccucuga

SEQ ID NO: 13169 - RNA, 9867 nt, Artificial Sequence
  derived and/or modified CDS sequence (opt2) from DENV-4__HQ332172__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccaccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccauccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucgcccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13170 - RNA, 9867 nt, Artificial Sequence
  derived and/or modified CDS sequence (opt2) from DENV-4__HQ332176__SS-prME
uccaccaucacccuccucugccucauccccaccgucauggccuuccaccucuccacccgcgacggcgagccccucaugaucgucgcccgccacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccuccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13171 - RNA, 9867 nt, Artificial Sequence
  derived and/or modified CDS sequence (opt2) from DENV-4__HQ332174__SS-prME
uccaccaucacccuccucugccucauccccaccgccauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggcccucaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccaccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccgccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggccgcgagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgccuccgaccucaaguacuccuggaagaccuggggcaaggccaagaucuucacccccgaggcccgcaacuccaccuuccucaucgacggccccgacaccuccgagugccccaacgagcgccgcgccuggaacuccuucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagcgcgccucccucaucgaggucaagaccugccucuggcccaagacccacacccucugguccaacggcguccucgagucccagaugcucauccccaaguccuacgccggccccuucucccagcacaacuaccgccagggcuacgccacccagaccaugggccccuggcaccucggcaagcucgagaucgacuucggcgagugccccggcaccaccgucaccauccaggagaacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcgccuccgagaccuucuccaugggccuccucugccucacccucuucgucgaggagugccuccgccgccgcgucacccgcaagcacaugauccucgccgucgucaucacccucugcgccaucauccucggcggccucaccuggauggaccuccuccgcgcccucaucaugcucggcgacaccauguccggccgcaucggcggccagacccaccucgccaucauggccgucuucaagaugucccccggcuacguccucggcgucuuccuccgcaagcucaccucccgcgagaccgcccucauggucaucggcauggccaugaccaccacccucuccaucccccacgaccucauggagcucaucgacggcaucucccucggccucauccuccucaagaucgucacccaguucgacaacacccaggucggcacccucgcccucucccucaccuucauccgcuccaccaugucccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccaucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggccaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcaccgucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcuccgcgagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13172 - RNA, 9867 nt, Artificial Sequence
  derived and/or modified CDS sequence (opt2) from DENV-4__KT026308__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacauggucgaccgcggcuggggcaacggcugcggccucuucggcaagggcggcgucgucaccugcgccaaguucuccugccucggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgagguccagcuccccgacuacggcgagcucacccucgacugcgagccccgcuccggcaucgacuucaacgagaugauccucaugaagaugaagaccaagaccuggcucguccacaagcagugguuccucgaccucccccuccccuggaccaccggcgccgacacccucgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcaccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgccgucggcggcaucacccucuuccucggcuucaccguccacgccgacaugggcugcgucgucuccugguccggcaaggagcucaagugcggcuccggcaucuucgucaucgacaacguccacaccuggaccgagcaguacaaguuccagcccgagucccccgcccgccucgccuccgccauccucaacgcccacaaggagggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucgucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccaucucccagcacaacuaccgccagggcuacgccacccagaccgccggccccuggcaccucggcaagcucgagaucgacuucggcgagugccccggcaccaccgucaccguccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucuccgccggccacggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccaggucggcacccucgcccucgcccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacaccgagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccgucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucaucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucucccacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaugggcaagcucuccaugggccucaucgccaucgccgucgccuccggccuccucugggucgccgagauccagccccaguggaucgccgccuccaucauccucgaguucuuccucaugguccuccucguccccgagcccgagaagcagcgcaccccccaggacaaccagcucaucuacgucauccucaccauccucaccaucaucgcccucgucgccgccaacgagaugggccucaucgagaagaccaagaccgacuucggcuucuaccaggucaaggccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaugggcgagacccucggcgagaaguggaagcgccagcucaacucccucgaccgcaaggaguucgaggaguacaagcgcuccggcauccucgaggucgaccgcaccgaggcccgcuccgcccucaaggacggcuccaagaucaaguacgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagaaggacgccgaccucggcgccggcacccgcuccgucuccaccgagaccgagaagcccgacaugaccaucaucggccgccgccuccagcgccuccaggaggagcacaaggagaccuggcacuacgaccacgagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccaggucgucaugaccaccaccgccaacuggcucuggacccuccucggccgcaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagaugaccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugcgccgcuacuccgcccacuucgaguccgagggcguccucuga

SEQ ID NO: 13173 - RNA, 9867 nt, Artificial Sequence
  derived and/or modified CDS sequence (opt2) from DENV-4__KT026309__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucauccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacauggucgaccgcggcuggggcaacggcugcggccucuucggcaagggcggcgucgucaccugcgccaaguucuccugccucggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgagguccagcuccccgacuacggcgagcucacccucgacugcgagccccgcuccggcaucgacuucaacgagaugauccucaugaagaugaagaccaagaccuggcucguccacaagcagugguuccucgaccucccccuccccuggaccaccggcgccgacacccucgagguccacuggaaccacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcaccggcgcccccugcaagguccccaucgagauccgcgacgucaacaaggagaaggucgucggccgcaucaucuccuccacccccuucgccgagaacaccaacuccgucaccaacaucgagcucgagccccccuucggcgacuccuacaucgucaucggcgucggcgacuccgcccucacccuccacugguuccgcaagggcuccuccaucggcaagauguucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggccuccucguccucuggaucggcaccaacucccgcaacaccuccauggccauguccugcaucgccgucggcggcaucacccucuuccucggcuucaccguccacgccgacaugggcugcgucgucuccugguccggcaaggagcucaagugcggcuccggcaucuucgucaucgacaacguccacaccuggaccgagcaguacaaguuccagcccgagucccccgcccgccucgccuccgccauccucaacgcccacaaggagggcgucugcggcauccgcuccaccacccgccucgagaacgucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgagacccgcaacuccaccuuccucgucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccaucucccagcacaacuaccgccagggcuacgccacccagaccgccggccccuggcaccucggcaagcucgagaucgacuucggcgagugccccggcaccaccgucaccguccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucaacgagaaggaggagaacauggucaagucccaggucuccgccggccacggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccaggucggcacccucgcccucgcccucaccuucaucaaguccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacaccgagggcgucuuccacaccauguggcacgucacccgcggcuccgucaucugccacgaguccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccgucuucaugaccgccaccccccccggcaccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucaucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccuccgcaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucucccacaaggucgccuccgccggcaucuccuacaaggaccgcgaguggugcuucaccggcgagcgcaacaaccagauccucgaggagaacaucgaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaugggcaagcucuccaugggccucaucgccaucgccgucgccuccggccuccucugggucgccgagauccagccccaguggaucgccgccuccaucauccucgaguucuuccucaugguccuccucguccccgagcccgagaagcagcgcaccccccaggacaaccagcucaucuacgucauccucaccauccucaccaucaucgcccucgucgccgccaacgagaugggccucaucgagaagaccaagaccgacuucggcuucuaccaggucaaggccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgucggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaugggcgagacccucggcgagaaguggaagcgccagcucaacucccucgaccgcaaggaguucgaggaguacaagcgcuccggcauccucgaggucgaccgcaccgaggcccgcuccgcccucaaggacggcuccaagaucaaguacgccgucucccgcggcaccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgccgccacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagaaggacgccgaccucggcgccggcacccgcuccgucuccaccgagaccgagaagcccgacaugaccaucaucggccgccgccuccagcgccuccaggaggagcacaaggagaccuggcacuacgaccacgagaaccccuaccgcaccugggccuaccacggcuccuacgaggcccccuccaccggcuccgccuccuccauggucaacggcgucgucaagcuccucaccaagcccugggacgucguccccauggucacccagcucgccaugaccgacaccacccccuucggccagcagcgcgucuucaaggagaaggucgacacccgcaccccccagcccaagcccggcacccaggucgucaugaccaccaccgccaacuggcucuggacccuccucggccgcaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagaugaccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccgcgacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaucgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgccaugcgccgcuacuccgcccacuucgaguccgagggcguccucuga

SEQ ID NO: 13174 - RNA, 9867 nt, Artificial Sequence
  derived and/or modified CDS sequence (opt2) from DENV-4__KF907503__SS-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaugaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccgacaugggcugcgucgucuccugguccggcaaggagcucaagugcggcuccggcaucuucgucgucgacaacguccacaccuggaccgagcaguacaaguuccagcccgagucccccgcccgccucgccuccgccauccucaacgcccacaaggacggcgucugcggcauccgcuccaccacccgccucgagaacgucauguggaagcagaucaccaacgagcucaacuacguccucugggagggcggccacgaccucaccgucgucgccggcgacgucaagggcguccucaccaagggcaagcgcgcccucaccccccccgucuccgaccucaaguacuccuggaagaccuggggcaaggccaagaucuucacccccgaggcccgcaacuccaccuuccucaucgacggccccgacaccuccgagugccccaacgagcgccgcgccuggaacucccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaguccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccuccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucaccgccggccagggcaccuccgagaccuucuccaugggccuccucugccucacccucuucgucgaggagugccuccgccgccgcgucacccgcaagcacaugauccucgucgucgucaucacccucugcgccaucauccucggcggccucaccuggauggaccuccuccgcgcccucaucaugcucggcgacaccauguccggccgcaucggcggccagauccaccucgccaucauggccgucuucaagaugucccccggcuacguccucggcgucuuccuccgcaagcucaccucccgcgagaccgcccucauggucaucggcauggccaugaccaccguccucuccaucccccacgaccucauggagcucaucgacggcaucucccucggccucauccuccucaagaucgucacccaguucgacaacacccaggucggcacccucgcccucucccucaccuucauccgcuccaccaugccccucaucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccucccgccgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacgucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccacccagaaggccgcccucuccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaucggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuccaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucauccucaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagacccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgcccccgcuggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggccgcgccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucaucaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaccgccucccucgucaugcucuccguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccauccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcaaccucguccgcugcccccucucccgcaacuccacccacgagauguacugggucuccggcgccuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggagaucgacaagaaggacggcgaccucauguacgccgacgacaccgccggcugggacacccgcaucaccgaggacgaccuccagaacgaggagcucaucaccgagcagauggccccccaccacaagauccucgccaaggccaucuucaagcucaccuaccagaacaaggucgucaagguccuccgccccaccccccgcggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcagaaccccaagggccucaaggagcgcgucgagaaguggcucaaggagugcggcgucgaccgccucaagcgcauggccaucuccggcgacgacugcgucgucaagccccucgacgagcgcuucggcaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuccgaguccgagggcguccucuga

SEQ ID NO: 13175 - RNA, 9867 nt, Artificial Sequence
  derived and/or modified CDS sequence (opt2) from DENV-4__AY947539__SS-prME
uccaccaugacccuccucugccucauccccaccgccauggccuuccaccucuccacccgcgacggcgagccccucaugaucgucgcccgccacgagcgcggccgcccccuccucuucaagaccaccgagggcaucaacaagugcacccucaucgccauggaccucggcgagaugugcgaggacaccgucaccuacgagugcccccuccucgucaacaccgagcccgaggacaucgacugcuggugcaaccucaccuccgccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaucaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacauccccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccugggccgccggcgccgacaccuccgagguccacuggaacuacaaggagcgcauggucaccuucaaggucccccacgccaagcgccaggacgucaccguccucggcucccaggagggcgccaugcacuccgcccucaccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcaucaucuccuccacccccuucgccgaguacaccaacuccgucaccaacaucgagcucgagccccccuucggcgacuccuacaucgucaucggcgucggcgacuccgcccucacccuccacugguuccgcaagggcuccuccaucggcaagaugcucgaguccaccuaccgcggcgccaagcgcauggccauccucggcgagaccgccugggacuucggcuccgucggcggccuccucaccucccucggcaaggccguccaccaggucuucggcuccgucuacaccaccauguucggcggcgucuccuggaugguccgcauccucaucggcuuccucguccucuggaucggcaccaacucccgcaacaccuccauggccaugaccugcaucgccgucggcggcaucacccucuuccucggcuucaccguccacgccgacaccggcugcgccgucuccugguccggcaaggagcucaagugcggcuccggcaucuucgucaucgacaacguccacaccuggaccgagcaguacaaguuccagcccgagucccccgcccgccucgccuccgccauccucaacgcccacgaggacggcgucugcggcauccgcuccaccacccgccucgagaacaucauguggaagcagaucaccaacgagcucaacuacguccucugggagggcggccacgaccucaccgucgucgccggcgacgucaagggcguccucuccaagggcaagcgcgcccucgccccccccgucaacgaccucaaguacuccuggaagaccuggggcaaggccaagaucuucacccccgaggccaagaacuccaccuuccucaucgacggccccgacaccuccgagugccccaacgagcgccgcgccuggaacuuccucgaggucgaggacuacggcuucggcauguucaccaccaacaucuggaugaaguuccgcgagggcuccuccgaggucugcgaccaccgccucauguccgccgccaucaaggaccagaaggccguccacgccgacaugggcuacuggaucgaguccuccaagaaccagaccuggcagaucgagaaggccucccucaucgaggucaagaccugccucuggcccaagacccacacccucugguccaacggcguccucgagucccagaugcucauccccaaggccuacgccggccccuucucccagcacaacuaccgccagggcuacgccacccagaccgucggccccuggcaccucggcaagcucgagaucgacuucggcgagugccccggcaccaccgucaccauccaggaggacugcgaccaccgcggccccucccuccgcaccaccaccgccuccggcaagcucgucacccaguggugcugccgcuccugcaccaugcccccccuccgcuuccucggcgaggacggcugcugguacggcauggagauccgcccccucuccgagaaggaggagaacauggucaagucccaggucuccgccggccagggcaccuccgagaccuucuccaugggccuccucugccucacccucuucgucgaggagugccuccgccgccgcgucacccgcaagcacaugauccucgucgucgucaccacccucugcgccaucauccucggcggccucaccuggauggaccuccuccgcgcccucaucaugcucggcgacaccauguccggccgcaugggcggccagauccaccucgccaucauggccgucuucaagaugucccccggcuacguccucggcaucuuccuccgcaagcucaccucccgcgagaccgcccucauggucaucggcauggccaugaccaccguccucuccaucccccacgaccucauggaguucaucgacggcaucucccucggccucauccuccucaagauggucacccacuucgacaacacccaggucggcacccucgcccucucccucaccuucauccgcuccaccaugccccucgucauggccuggcgcaccaucauggccguccucuucgucgucacccucaucccccucugccgcaccuccugccuccagaagcagucccacugggucgagaucaccgcccucauccucggcgcccaggcccuccccgucuaccucaugacccucaugaagggcgccuccaagcgcuccuggccccucaacgagggcaucauggccgucggccucgucucccuccucggcuccgcccuccucaagaacgacgucccccucgccggccccauggucgccggcggccuccuccucgccgccuacgucauguccggcuccuccgccgaccucucccucgagaaggccgccaacguccagugggacgagauggccgacaucaccggcuccucccccaucaucgaggucaagcaggacgaggacggcuccuucuccauccgcgacaucgaggagaccaacaugaucacccuccucgucaagcucgcccucaucaccgucuccggccucuacccccucgccauccccgucaccaugacccucugguacauguggcaggucaagacccagcgcuccggcgcccucugggacguccccucccccgccgccgcccagaaggccacccucaccgagggcgucuaccgcaucaugcagcgcggccucuucggcaagacccaggucggcgucggcauccacauggagggcgucuuccacaccauguggcacgucacccgcggcuccgucaucugccacgagaccggccgccucgagcccuccugggccgacguccgcaacgacaugaucuccuacggcggcggcuggcgccucggcgacaagugggacaaggaggaggacguccagguccucgccaucgagcccggcaagaaccccaagcacguccagaccaagcccggccucuucaagacccucaccggcgagaucggcgccgucacccucgacuucaagcccggcaccuccggcucccccaucaucaaccgcaagggcaaggucaucggccucuacggcaacggcgucgucaccaaguccggcgacuacgucuccgccaucacccaggccgagcgcaccggcgagcccgacuacgaggucgacgaggacaucuuccgcaagaagcgccucaccaucauggaccuccaccccggcgccggcaagaccaagcgcauccuccccuccaucguccgcgaggcccucaagcgccgccuccgcacccucauccucgcccccacccgcgucgucgccgccgagauggaggaggcccuccgcggccuccccauccgcuaccagacccccgccgucaaguccgagcacaccggccgcgagaucgucgaccucaugugccacgccaccuucaccacccgccuccucuccuccacccgcguccccaacuacaaccucaucgucauggacgaggcccacuucaccgaccccuccuccgucgccgcccgcggcuacaucuccacccgcgucgagaugggcgaggccgccgccaucuucaugaccgccaccccccccggcgccaccgaccccuucccccaguccaacucccccaucgaggacaucgagcgcgagauccccgagcgcuccuggaacaccggcuucgacuggaucaccgacuaccagggcaagaccgucugguucguccccuccaucaaggccggcaacgacaucgccaacugccuccgcaaguccggcaagaaggucauccagcucucccgcaagaccuucgacaccgaguaccccaagaccaagcucaccgacugggacuucgucgucaccaccgacaucuccgagaugggcgccaacuuccgcgccggccgcgucaucgacccccgccgcugccucaagcccgucaucuccaccgacggccccgagcgcgucauccucgccggccccauccccgucacccccgccuccgccgcccagcgccgcggccgcaucggccgcaaccccgcccaggaggacgaccaguacgucuucuccggcgacccccucaagaacgacgaggaccacgcccacuggaccgaggccaagaugcuccucgacaacaucuacacccccgagggcaucauccccacccucuucggccccgagcgcgagaagaaccaggccaucgacggcgaguuccgccuccgcggcgagcagcgcaagaccuucgucgagcucaugcgccgcggcgaccuccccgucuggcucuccuacaaggucgccuccgccggcaucuccuacaaggaccgcgaguggugcuucaccggcgagcgcaacaaccagauccucgaggagaacauggaggucgagaucuggacccgcgagggcgagaagaagaagcuccgccccaaguggcucgacgcccgcgucuacgccgaccccauggcccucaaggacuucaaggaguucgccuccggccgcaaguccaucacccucgacauccucaccgagaucgccucccuccccaccuaccucuccucccgcgccaagcucgcccucgacaacaucgucaugcuccacaccaccgagcgcggcggcaaggccuaccagcacgcccucaacgagcuccccgagucccucgagacccucaugcucgucgcccuccucggcgccaugaccgccggcaucuuccucuucuucaugcagggcaagggcaucggcaagcucuccaugggccucaucgccaucgccgucgccuccggccuccucugggucgccgagauccagccccaguggaucgccgccuccaucauccucgaguucuuccucaugguccuccucauccccgagcccgagaagcagcgcaccccccaggacaaccagcucaucuacgucauccucaccauccucaccaucaucggccucaucgccgccaacgagaugggccucaucgagaagaccaagaccgacuucggcuucuaccaggucaagaccgagaccaccauccucgacgucgaccuccgccccgccuccgccuggacccucuacgccgucgccaccaccauccucacccccaugcuccgccacaccaucgagaacaccuccgccaaccucucccucgccgccaucgccaaccaggccgccguccucaugggccucggcaagggcuggccccuccaccgcauggaccucggcgucccccuccucgccaugggcugcuacucccaggucaaccccaccacccucaucgccucccucgucaugcuccucguccacuacgccaucaucggccccggccuccaggccaaggccacccgcgaggcccagaagcgcaccgccgccggcaucaugaagaaccccaccgucgacggcaucaccgucaucgaccucgagcccaucuccuacgaccccaaguucgagaagcagcucggccaggucaugcuccucguccucugcgccggccagcuccuccucaugcgcaccaccugggccuucugcgagguccucacccucgccaccggccccguccucacccucugggagggcaaccccggccgcuucuggaacaccaccaucgccgucuccaccgccaacaucuuccgcggcuccuaccucgccggcgccggccucgccuucucccucaucaagaacgcccagaccccccgccgcggcaccggcaccaccggcgagacccucggcgagaaguggaagcgccagcucaacucccucgaccgcaaggaguucgaggaguacaagcgcuccggcauccucgaggucgaccgcaccgaggccaaguccgcccucaaggacggcuccaagaucaagcacgccgucucccgcggcuccuccaagauccgcuggaucgucgagcgcggcauggucaagcccaagggcaaggucgucgaccucggcugcggccgcggcggcugguccuacuacauggccacccucaagaacgucaccgaggucaagggcuacaccaagggcggccccggccacgaggagcccauccccauggccaccuacggcuggaaccucgucaagcuccacuccggcgucgacgucuucuacaagcccaccgagcaggucgacacccuccucugcgacaucggcgaguccuccuccaaccccaccaucgaggagggccgcacccuccgcguccucaagauggucgagcccuggcucuccuccaagcccgaguucugcaucaagguccucaaccccuacaugcccaccgucaucgaggagcucgagaagcuccagcgcaagcacggcggcucccucguccgcugcccccucucccgcaacuccacccacgagauguacugggucuccggcgucuccggcaacaucgucuccuccgucaacaccaccuccaagaugcuccucaaccgcuucaccacccgccaccgcaagcccaccuacgagaaggacgucgaccucggcgccggcacccgcuccgucuccaccgagaccgagaagcccgacaugaccaucaucggccgccgccuccagcgccuccaggaggagcacaaggagaccuggcacuacgaccaggagaaccccuaccgcaccugggccuaccacggcuccuacgaggcccccuccaccggcuccgccuccuccauggucaacggcgucgucaagcuccucaccaagcccugggacgucauccccauggucacccagcucgccaugaccgacaccacccccuucggccagcagcgcgucuucaaggagaaggucgacacccgcaccccccagcccaagcccggcacccgcauggucaugaccaccaccgccaacuggcucugggcccuccucggcaagaagaagaacccccgccucugcacccgcgaggaguucaucuccaagguccgcuccaacgccgccaucggcgccgucuuccaggaggagcagggcuggaccuccgccuccgaggccgucaacgacucccgcuucugggagcucgucgacaaggagcgcgcccuccaccaggagggcaagugcgaguccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucggccgcgagaacuccugguccggcgucgagggcgagggccuccaccgccucggcuacauccucgaggacaucgacaagaaggacggcgaccucaucuacgccgacgacaccgccggcugggacacccgcaucaccgaggacgaccuccucaacgaggagcucaucaccgagcagauggccccccaccacaagauccucgccaaggccaucuucaagcucaccuaccagaacaaggucgucaagguccuccgccccacccccaagggcgccgucauggacaucaucucccgcaaggaccagcgcggcuccggccaggucggcaccuacggccucaacaccuucaccaacauggagguccagcucauccgccagauggaggccgagggcgucaucacccaggacgacaugcacaaccccaagggccucaaggagcgcgucgagaaguggcucaaggagugcggcgucgaccgccucaagcgcauggccaucuccggcgacgacugcgucgucaagccccucgacgagcgcuucuccaccucccuccucuuccucaacgacaugggcaagguccgcaaggacaucccccagugggagcccuccaagggcuggaagaacuggcaggagguccccuucugcucccaccacuuccacaagaucuucaugaaggacggccgcucccucgucguccccugccgcaaccaggacgagcucaucggccgcgcccgcaucucccagggcgccggcuggucccuccgcgagaccgccugccucggcaaggccuacgcccagauguggucccucauguacuuccaccgccgcgaccuccgccucgccuccauggccaucugcuccgccguccccaccgagugguuccccaccucccgcaccaccugguccauccacgcccaccaccaguggaugaccaccgaggacaugcucaaggucuggaaccgcgucuggaucgaggacaaccccaacaugaccgacaagacccccguccacuccugggaggacauccccuaccucggcaagcgcgaggaccucuggugcggcucccucaucggccucuccucccgcgccaccugggccaagaacauccacaccgccaucacccagguccgcaaccucaucggcaaggaggaguacgucgacuacaugcccgucaugaagcgcuacuccgcccccuucgaguccgagggcguccucuga

SEQ ID NO: 13176 - RNA, 9879 nt, Artificial Sequence
  derived and/or modified CDS sequence (opt3) from DENV-1__AB608789__SS-prME
agcgugaccaugcugcucaugcuuaugcccaccgcacuggcuuuccacuugacuacgaggggcggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauaucgacuguuggugcaaugcuacugauacaugggugaccuaugggacguguucacaaacuggagagcaccgccgagacaagcguaguguggcccuugcaccccaugugggccuggguuuggagaccagaacagaaacuuggaugagcuccgagggggccuggaaacagauucagagggucgaaaccugggcucuccggcacccuggauucacagugaucgcacuguuucuggcccaugcuauuggcaccucuaucacgcagaagggcauaaucuucauucucuuaaugcugguuacuccaucgauggccaugcgcugcguggggaucggaucaagagauuuugucgagggucuuagcggcgcgacauggguggacguaguuuuggagcacgggaguugugugaccacuauggcaaaggauaaacccacacuggacauugaacuacucaagaccgaggucacgaacccugccgugcugaggaaacuuugcaucgaagcuaagauauccaauaccacaacugauucucgguguccaacccaaggagaggccacacugguggaggaacaggacgcaaacuucgucugccgccgaacuuuuguugauagaggcugggguaauggguguggauuguucggcaaaggcagccucauuaccugcgcuaaguuuaagugcgugacaaaacuggaggggaagaucguacaguacgaaaacuuaaaauauuccgugauugucaccgugcacacuggagaccagcaucaaguugguaaugagucaacggaacacggcacaaccgccacuaucacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacuggaucguucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagagaggcucaaguauuggaaaaauguuugaggcaacugccaggggcgcucggcgaauggccauccugggggauaccgcaugggacuucggaagcauugguggcguguuuacauccguugggaaacuugugcaucagauauucggaacggcguacggcguccuguuuucuggugugagcuggaccaugaaaaucgggauuggcguauugcucacuuggcugggauuaaauucacgcaguacaucccugagcaugaccuguaucgcugugggccuaguuacacucuaccugggggucauggugcaggccgauucuggaugcgugaucaacuggaagggcagagaacuuaaaugugguucagggauuuucgucacuaaugagguucacaccuggacggaacaauauaaguuucaggcagacaguccgaagagguugagcgccgcuauaggaaaagccugggaggagggcgugugcgguauccgguccgcaacacgccuggaaaacauuauguggaagcagaucucuaacgagcucaaucauauucuguuagaaaacgacaugaaauucaccgugguagucggcgaugugguugggauccuggcucagggaaagaaaaugauaagaccucaacccauggaguacaaguauucguggaaaagcuggggcaaggccaagaucauuggggcggacgugcagaauacuaccuuuaucauugauggaccaaacacaccugaaugucccgacgaucagagggccuggaauaucugggaggucgaggacuacggcuucgguauauuuacuaccaacauuuggcuuaaauugcgugauuccuauacacaggugugcgaccaccggcucaugucagcugcaaucaaggauaguaaagccguucacgcugacaugggguacuggauugaaucugagaagaaugaaacguggaaacuggcccgagcauccuucaucgaggugaagaccuguauauggccaaagucccauacucuauggucaaacggaguacuggaaagcgagaugaucauucccaaaaucuauggcgguccuauuucucaacacaauuacagaccaggcuacuucacacagaccgcggggccguggcaucucggaaagcuggagcuugauuuugacuugugcgaaggcacuacagucgugguggaugagcacugcgggaacaggggacccucccugcgcaccacgacugucaccggcaaaaucauacacgaaugguguugccggaguuguacauuaccuccacucagauucaagggugaggacgggugcugguauggaauggagauuaggcccguuaaagaaaaggaggaaaaucugguaaagagcaugguaucugccggcuccggugagguggacucauuuagucuuggccuguuguguaugagcaucaugaucgaagaggucaugcgcucgcgauggucccggaaaaugcucaugaccgggacucuggcuguguuccuacugcucauuaugggacagcugacauggaacgaucuuauccguuugugcauuaugguuggcgccaaugcaucugacagaauggggaugggaaccacauaccuggcuuuaauggccacuuuuaagaugaggccuauguucgcagugggccuccuguuucgccggcuuaccagcagagagguccugcuacucacgauaggucugucauugguggccaguguugaacugccaaacuccuuagaggaacucggggauggacuggcuaugggcaucaugauucuuaaacuguugacagacuuccaaucucaucagcucugggcgacccugcuaagccugacuuuuaucaagaccacagugucccuucacuaugccuggaaaacuauggcaaugguccucucaauuguaagccuguuccccuugugucugaguaccacgucucagaagacaaccugguuaccggugcuccugggcucccuugggugcaagccucugacuauguuuuugaucgcugagaauaaaauauggggaagaaagagcuggccacucaacgaagguaucauggccguuggcauugugucgauccugcuaucaucucugcuuaaaaacgaugucccccucgccgggccucugauugcuggaggcauguugaucgcauguuacgugauaagugguuccagcgccgacuuaucucuggagaaggcggcugagguaagcugggaagaggaagccgagcauuccggggcaucacacaauauucucguggaaguccaggaugacggaacaaugaaaaucaaggaugaggagcgagacgauacccugacuauccuucugaaagccacauugcuagcuguuaguggcguguauccccugagcauuccagcaacccucuucgugugguacuuuuggcaaaagaagaaacagcgcucuggcguccugugggacacgccuucacccccagaaguggagcgggccguucuugaugaagggauauauagaaucaugcagaggggauuacugggucguagccagguaggcgugggggucuuccaagagaacguguuccauacuauguggcacguuacccgcggagcggugcucauguaccagggcaagcgguuggagccgaguugggcuagcgucaaaaaggaccugauuuccuacggugggggauggagacuccagggcucuuggaauacaggcgaagaggugcagguaaucgccgucgaaccugggaaaaaccccaagaaugugcaaaccgcaccaggaacauuuaagacucccgagggugaaguuggcgccauugcucuggacuucaaaccugggaccucgggaagcccaaucgugaacagggagggcaagauagucggucuuuaugggaauggagugguuacgacaucaggcacuuacguguccgccaucgcacaggcuaaagccagucaggagggcccccugccugaaauugaggaugaagucuuucgaaagcggaacuugaccaucauggaccuacacccggggucuggaaaaacacgcagauaucugccagcgauugugagggaggccaucaagcggaagcuccgaaccuuaauacuggcacccacuagaguaguggcuagcgaaauggccgaggcucuuaaagguaugccuauucgcuaccaaaccacagcaguuaaguccgagcauacgggcaaagaaaucgucgaucugaugugccacgccacuuucaccaugaggcucuugucaccagugcgugugcccaauuauaacaugaucauuauggacgaggcccauuuuacagauccuucuagcaucgcugcgcggggguacauaaguaccagagucggaaugggcgaagcagccgcuauuuucaugacugccacaccgcccgguuccguagaggcauuuccacagagcaaugccgugauccaggacgaagagagggauauuccugagcgcucuuggaacucaggguaugaauggaucaccgacuuccccggaaagacgguuugguuugugccauccauaaaaaguggcaaugauauugcuaacugucugcgaaagaauggcaagagagucauccagcucagccggaaaacuuucgacacagaguaccaaaagaccaaaaacaacgauugggacuacgugguuaccacugacaucucggaaaugggggcgaauuuuagggccgaucgcgugauugacccucguagaugccugaagcccgucauccuuaaagauggaccagagcgggugauucuagcagguccgaugccuguaacaguggcuucugccgcacagaggcgcggccgaauagggagaaaccacaauaaggagggagaccaguauaucuacaugggccagccccugaacaaugaugaagaccaugcccacuggaccgaggcuaagauguuguuagauaacauuaauacaccagaagguaucauccccgcccuguucgagccugaacgggagaaauccgcggcaauugacggggaguauaggcuccgcggcgaagccagaaagacuuucguugagcugaugaggcggggagaucuuccagucuggcugagcuacaaaguggcuucagaaggcuuucaauauagugaccgucgcuggugcuucgauggggagcgaaacaaucaggugcucgaagagaacauggacgucgagauauggacgaaggaaggagagaggaagaaguugaggccccgguggcuggaugcccgcaccuacucugacccucuagcucugagagaauuuaaagaguucgcagccgguaggcgguccguuagcggcgaccucauccuugaaauugggaagcugccgcagcacuuaacacagcgagcucaaaaugccuuggauaaccuggugaugcuccauaauucagagcagggaggcagagcauaucgccacgcgauggaggaacugccagacacuaucgagacccuuaugcugcucgccuugauugcuguacugacagguggggugaccuuauuuuuccuaaguggcaggggacugggcaagacuagcaucgggcuccuuugugucauggccuccucugugcuguuguggauggcaagcguugaaccccauuggauagcugccuccaucauucuggaguuuuuccucauggugcugcuuaucccugagcccgaucggcagcguacgccacaggacaaccaacucgcauacgucguaauuggacuguuguuuaugauccugaccguggccgcuaaugaaauggguuuacuagagacaacuaaaaaggaucugggcauagggcacguugcgguggaaaaccaccaucacgccaccaugcucgacgucgaucuucauccugcaucagcuuggacacuguacgccguggccaccacuauuaucacacccaugaugagacacacgauugagaacaccacugcaaauaucucuuugacagcuauagccaaccaggcggcuauccugaugggacucgacaaaggcuggccaauuaguaagauggauaucggugucccucugcuugccuuagggugcuauagccaggugaauccgcugacccucaccgcagccguuuugaugcugguggcucauuacgcaauuaucggccccggacuacaagccaaagcgacaagggaagcucagaagcgcacugccgcaggcauaaugaagaacccaacgguagacgggauuguggccaucgaucuggacccugucguuuaugaugcuaaauucgagaagcagcucggacagaucaugcuucugauuuuguguaccagccaaauccugcucaugcggacaacuugggcccugugcgaguccauaaccuuagcaacaggcccccuuaccacucugugggaagguucuccagggaaauuuuggaauacgacaauugcugugucaauggccaacaucuuccgaggaagcuaccucgcgggcgccggucuagcauuuucccugaugaagaguuugggcgggggaagaaggggcaccggggcucagggagagacucugggcgaaaaauggaagcgccagcucaaucagcuuucuaagagcgaguucaacaccuauaaacggucagguauuauggaagucgacagauccgaggccaaggagggggugaaacguggagaaacaacuaagcacgcaguaaguaggggcaccgcuaaacugcggugguucguggagcgcaauuugguuaagccugaagguaaggugaucgaccugggcugugggcgaggaggcuggagcuacuauugcgccgggcucaaaaaggucacagaggugaaaggauacacgaagggcggucccgggcacgaggaaccgauaccaauggccaccuacggauggaacuuagucaaacugcauucuggcaaggauguguuuuucacuccucccgagaaaugugacacacuucugugcgauaucggcgaauccucaccaaaucccaccauugaggaagggagaacucuaaggguucucaagaugguagagccuuggcugcggggaaaccaauuuuguaucaagauuuugaauccguauaugcccagcguggucgagacacuggaacagaugcagcgcaaacacgguggcaugcucgugagaaacccacuuucgagaaauucuacccaugagauguacuggguuaguugcgggacgggaaacaucguguccgcggucaauaugaccagccgaaugcuguuaaaccgguucacaauggcucaccguaagccuacuuaugaaagagacguggaucugggcgcagguacccgccacguagccguggagcccgaaguugcuaacuuggacauuaucgggcagaggauagagaauauuaaacaugagcacaagucaacauggcauuacgaugaagacaacccuuauaaaacuugggccuaccacggauccuaugaggucaagccaucuggcagcgcaaguuccauggugaauggcguggucaagcuccugaccaaacccugggauguuaucccuauggugacacaaaucgccaugaccgacacuacgccauuugggcagcagcggguauucaaggaaaaaguggauacaagaacccccaaggcuaaacgcggaacugcgcaaauuauggaggucaccgccagguggcuaugggguuuucuuagccgaaacaagaagccgcggauauguacaagagaagaguucacgaggaaagugcgcucuaaugcagcuaucggcgccguuuuuguggacgagaaccaguggaacucagcaaaggaagccgucgaggacgaacguuucugggaucuggugcaucgggagagagaacuccacaaacaggggaagugcgcuaccugcguauacaacaugaugggaaaaagggagaagaagcugggcgaguuugguaaagccccugaaagucgcgcgauuugguacaugugguugggggcacgauuccuggaguuugaagcccucggauucaugaaugaggaccacugguucucccgggagaacagccuuucuggcguugaaggcgaggggcugcauaaguuaggauauauccugagagauauuucgaaaaucccagguggcaauauguacgcugacgauacugccgggugggacacaaggauaaccgaagaugacuugcagaacgaggcaaagaucacugauauuauggaacccgagcacgcucuccuggccacaucaaucuuuaaacuaaccuaucaaaauaaggugguccgcgugcagagaccugcuaaaaacggaacagugauggacgucauuagccggagggaucagcguggcuccggucagguugggacuuacggacuuaauaccuucacgaacauggaggcccaacugauccgacagauggaaagugagggcauauuuucuagcuccgaacucgagaccccaaaccuggcagaacgcguguuggacugguuaggcaaguaugggguagagagacugaagcggauggcgauuucaggagaugacuguguggucaaacccaucgacgauagguucgccacagcucucacugcccuuaaugacguggguaagguucgcaaagauaucccgcagugggagccuaguaagggcuggaacgacuggcagcaagugcccuuuugcucucaucacuuccaccagcugauuaugaaagaugggagagaaauagucgugccaugucggaaucaggacgagcuaguaggaagggcacgaguuagccagggcgcugguuggucccugcgugaaaccgccugccucgggaagucauacgcacaaauguggcaguugauguauuuucauagacgcgaucugcggcuugccgcgaacgcuaucuguagcgccgugccugucgacugggugcccacaucuaggacuaccugguccauucacgcacaucaccaguggaugacgacagaggauaugcugaguguuuggaauagaguguggaucgaagagaacccauggauggaggacaagacccaugucagcucguggggagaugugcccuaccucggcaaacgcgaagaccaauggugcggcuccuuaauugggcugacugcccgggcuacaugggccaccaauauccagguagcaauaaaccaggugaggcgauugaucggaaaugagaacuaccuggacuauaugacuucuaugaagagauucaaaaaugaaucagauccugagggugcucucugguga

SEQ ID NO: 13177 - RNA, 9879 nt, Artificial Sequence
  derived and/or modified CDS sequence (opt3) from DENV-1__AB608788__SS-prME
agcgugaccaugcugcucaugcuucugcccaccgucuuggccuuccacuuaacuacgagaggaggggagccucauaugaucguuaccaagcaggaaaggggaaaaucccugcuauuuaagacaucugcuggugugaauaugugcacucucauugccauggaccugggcgagcuuugugaagauaccaugacauacaaaugcccacggauaaccgaggccgaaccggacgauguagacuguuggugcaaugcgacugauacaugggugaccuaugggacguguucacaaacuggagagcaccgccgagacaagcguagugucgcucuggcaccccaugugggcuugggucucgagaccagaacagaaacuuggauguccuccgagggggcguggaaacagauccagaggguugaaaccugggcccugcggcacccuggauucacagugauugcucuguuucucgcacaugccaucggcaccucuauuacgcagaagggcaucauauucaucuuacugaugcuugucacuccaucgauggcuaugcgcugcguggggauuggaaacagagauuuuguagaggguuugucaggcgccacauggguugacgugguccuggagcacgggagcugugugaccacuauggcgaaggauaaacccacacuagacaucgaacuccugaagaccgaggugacgaauccugcaguccuuaggaaacugugcauugaagccaagaucaguaacaccacaacugauucccgguguccaacccaaggagaggcuacauugguugaagaacaagacgccaauuucgugugccgccgaacuuuuguagauagaggcugggguaacggguguggacucuucggcaaaggcucucugauaaccugcgcaaaguuuaagugcgugacaaaauuagaggggaagauuguccaguacgaaaaucugaaauauagcgugaucguuaccgugcacacuggagaccagcaucaagucgguaacgaguccacggaacacggcacaaccgcuacuauuacaccccaggccccuacaucagagauccagcucaccgacuacggggcgcuuacucuggauuguaguccaaggacaggauuggacuucaaugaaauggugcuacugacgaugaaggagaaaagcuggcucguacauaagcagugguuucuggaucuuccgcugcccuggaccucuggcgccacuacaucccaagagaccuggaaccggcaggacuugcucguuacauucaaaacugcacacgcuaagaagcaggaaguggucgugcuggguucacaagagggggccaugcacaccgcuuuaacgggcgccaccgaaauccagacaagcggaacuaccacaauuuuugcaggccaucugaaaugccgucuaaagauggauaaacucacucugaaggggaugaguuaugucauguguaccggaucuuucaaacuugagaaggaaguggccgagacgcagcacgguacaguuuuggugcagguaaaguacgagggcaccgacgcuccuugcaaaauaccauucuccacucaagaugaaaagggggucacacagaauggacgcgugaucaccgcgaaccccauuguuacugacaaagagaagccugugaauaucgaagcagagccacccuuuggcgagagcuauauagucgugggugccggggaaaaagcucugaagcucucgugguucaagaaaggcucuaccauuggaaagauguuugaggccacagcaagaggcgccaggcggauggcuauccugggggauacggccugggacuucggauccaucgguggcguauuuaccucaguggggaaacuuguucaucagauuuucggaacugcauacggcguccuguuuaguggugugagcuggacaaugaagaucgggauuggcguguugcucaccuggcugggauuaaacucccgaucuacaagccugucaaugacuuguauagcggucggccuaguuacccucuaccugggggugauggugcaggcugauaguggauauguaaucaauuggaaaggccgcgaacuuaagugcgguuccgggauuuucgucacgaacgaggugcacacauggaccgaacaauacaaguuucaggccgacagcccgaaaagauugucugcagccaucggaaaggcuugggaggagggcguuugugguaucaggucagccacucggcuggaaaacauuauguggaaacagauaaguaaugagcucaaccauauccuguuagaaaaugacaugaaguucaccguggucgugggcgauguuagcgggauucuggcacagggcaagaagaugauccgcccucaacccauggagcacaaauauuccuggaagucuuggggcaaggcuaaaauuaucggggccgacgugcagaacucgacauuuauaaucgauggaccaaauacuccugaaugccccgacgaucagagagcguggaacauuugggagguagaggacuacggcuucgguaucuuuaccacaaauauuuggcuuaaguugagggauagcuauacgcaggucugugaccaccgucucauguccgccgcuaucaaagauucaaaggcagugcaugccgacaugggguacuggauagaaagugagaaaaacgaaaccuggaagcuggcucgggccucuuucauugaggugaagacuugcgucuggccaaaaagccacacacuaugguccaauggaguucuggaaucagagaugaucauucccaagaucuauggcgguccuauaagccaacauaacuaccgaccaggcuacuucacccagacuucugggccguggcaccucggaaaacuggagcuugauuuugacuugugugaaggcacaaccgugguaguggaugagcacugcgggaauagaggacccucccugaggacgacuaccgucacaggcaagaucauucaugaauggugcugucgcaguugcaccuuaccuccacuccgguucaaaggugaggacggguguugguauggaauggagaucagacccgugaaggaaaaggaggaaaaccugguuaaaagcauggugucugcaggcuccggugaggucgacucauuuagucuuggccuguugugcauuagcaucaugauagaagaggugaugaggucgcgcuggucccgaaagaugcucaugacugggacacuggcgguuuuccuacugcucauuaugggacagcugaccuggaaugaucuuauccgguuguguaucauggugggcgccaacgcuucugaccguauggggaugggaacaacuuaccuggccuuaauggcaaccuuuaaaaugagaccuauguucgcugucggccuccuguuuaggcgccuuacgagccgggagguacugcuacucacaauuggucugucauugguggccaguguugaacugccaaauuccuuagaggaacucggggauggacuggcaaugggcaucaugauucuuaagcuguugaccgacuuccaaucucaccagcucugggccgcucugcuaagccugacuuuuauaaaaaccacauucucccuucauuaugcguggaagacuauggccauggugcucucaaucgucagccuguuucccuugugccugaguaccacgucucagaagacaaccugguuaccggugcuccugggcucccuuggguguaaaccucugacuauguucuugauugcagagaacaagaucuggggaagaaaaagcuggccacucaacgaagguauuauggcuguaggcaucgugucgauacugcuaucaucucugcuuaagaaugaugucccccucgccgggccucugaucgccggaggcauguugauugcuugcuacguuaucagugguuccagcgcagacuuaucucuggagaaagccgcggaggugagcugggaagaggaagcugagcacuccggggccucacauaacauucucguggaaguccaggaugacggaacaaugaagaucaaagaugaggagagggacgauacccugacuauacuucugaaggcaacauugcuagccgugaguggcguuuauccccugagcauuccagcuacccucuuuguaugguacuucuggcaaaagaaaaagcagcgaucuggcgugcugugggacacgccuucacccccagaagucgagcgcgcagugcuugaugacgggaucuaucggaucaugcagagaggauuacuggguaggagccagguuggcgugggggucuuccaagaaaauguguuucacacuauguggcacguaacccguggagccguccucauguaccagggcaaacgcuuggagccgaguugggcgagcgugaagaaagaccugauuuccuacggugggggauggcggcuccagggcucuuggaacacaggcgaggaaguucaggugauagcugucgagccugggaagaaucccaagaacgugcaaaccgccccaggaacauucaaaacucccgaaggugagguuggcgcaaucgcccuggauuuuaagccugggaccucgggaagcccaauugugaauagagaaggcaaaaucgucggucuuuaugggaacggagugguaacgacaucaggcacuuacguguccgcuauugcccaggcaaaggcuagucaggagggcccccugccugagaucgaagacgagguuuucaggaaacgaaauuugaccauaauggaucuacauccggggucuggaaagacacggcgcuaucugccagccaucgucagagaagcgauuaagaggaaacuccggaccuuaauccuggcccccacucgagugguggcaagcgagauggcugaagcccuuaaggguaugccuauuagauaccaaaccacagcugucaaauccgagcacacgggcaaggagaucguagaccugaugugucaugcaacuuuuaccaugcgccucuugucaccagugaggguucccaacuauaauaugauaauuauggaugaagcccacuucacagacccuucuagcaucgccgcucguggguacaucaguacccgggugggaaugggcgaggcggcagccauuuuuaugacugcuacaccgcccgguuccgucgaagccuucccacagagcaacgcagugauccaggaugaggaaagagacauaccugagaggucuuggaacucaggguaugauuggauuaccgacuuucccggaaaaacgguuugguucgugccauccaucaagaguggcaacgauauugccaauugccugcgcaagaacggcaaacgagucauccagcucagcagaaagacuuuugacacagaguaccagaaaaccaagaacaaugacugggauuacgugguaaccacugacauaucggaaaugggggcuaacuuccgggcggauagggugauugacccucgccguugucugaaacccguuauccuuaaggauggaccagagagagucauccuagccgguccgaugccugugacaguggcaucugcugcccagcggaggggccgcauugggcgaaaucagaacaaggaaggagaccaguauaucuacaugggccaaccccugaauaacgaugaggaccaugcacacuggaccgaggccaaaauguuguuagauaauauuaacacaccagaagguauaauccccgcucuguucgagccugaaagagagaaguccgccgcgauugacggggaauaucggcucaggggcgaggcacgcaaaacuuuugucgagcugaugagaaggggagaucuuccaguuuggcugagcuacaagguggccucagaaggcuuccaguauagugaccggcguuggugcuuugauggggagcgcaauaaccagguacucgaagagaauauggacguggaaaucuggacgaaagagggagagcgaaagaaauugagacccagguggcuggacgcucggaccuacucugauccucuagcccugcgcgaguucaaggaguuugcugcagguagaagguccgucagcggcgaccucauccuugaaauugggaagcugccgcagcacuuaacacaacgggcccagaacgcuuuggauaaucuggugaugcuccauaacucagagcagggaggccgagccuauagacacgcaauggaagaacugccagacacuauagagacccuuaugcugcucgcguugaucgccguucugacagguggggugaccuuauucuuucuaaguggccgcggacugggcaaaacuagcauugggcuccuuugcgucauggcuuccucuguacuguuguggauggccagcguggaaccccauuggaucgcagcuuccauuauccuggaguucuuucucaugguucugcuuauaccugaacccgauaggcagcggacgccacaagacaaucagcucgccuacguggucaucggacuguuguucaugauucugaccguggcagccaacgagauggguuuacuagagacaacuaagaaagaucugggcaucgggcacgucgcuguggaaaaccaccaucacgcgaccaugcucgacguugaucuucauccugccucagcauggacacuguacgcuguggccaccacuauuaucacacccaugaugcgucacacgauagagaauaccacugccaacauuucuuugacagcaaucgcuaaucaggccgcgauucugaugggacucgacaagggcuggccaaucaguaaaauggauauagguguaccucugcuugcuuuaggguguuauucgcaagugaacccgcugacccucaccgccgcagucuugaugcugguugcccauuacgcuaucauuggccccggacuacaggcaaaggccacaagagaagcgcagaagaggacugcugccggcaucaugaaaaauccaacgguggacgggauugucgcaaucgaucuggacccugugguauaugacgccaaguuugagaaacagcucggacaaauaaugcuucugauuuugugcaccagccagauccugcucaugcgcacaacuugggcucugugugaauccaucaccuuagccacaggcccccuuaccacucugugggaggguucuccagggaaguucuggaacacgacaauugcagugucaauggcuaauaucuuucggggaagcuaccucgccggcgcgggucuagccuucucccugaugaaaaguuugggcgggggacgaagaggcaccggggcacagggagagacucugggcgaaaaguggaagaggcagcucaaccaacuuucuaaaagcgaguucaauaccuauaagcgcucagguauaauugaaguugaucgguccgaggcuaaagaagggcugaagagaggagagacaacuaaacacgccgugagucguggcaccgcaaaguugaggugguuugucgagcggaaccuggugaagccugaagguaaagucaucgaccucggcugcgggcgcggaggcuggagcuacuauugugcuggguuaaagaaagugacagagguuaagggauacacgaaaggcggugccgggcacgaggaacccauuccgauggccaccuacggauggaaucugguaaaacuuuauucuggcaaagauguguucuuuacuccaccugaaaagugcgacacacugcuaugugauaucggcgaguccucacccaacccaaccauagaggaagggcgaacucucagaguccugaagaugguggagcccugguugaggggaaaucaguucugcaucaaaauucugaacccuuacaugccgagcguuguggaaacacucgagcagaugcagcggaagcaugguggcaugcuuguccgcaauccccugucgagaaacucuacccacgagauguauugggugaguugugggacgggaaauaucguauccgcggugaacaugaccagcaggauguuacugaaccgauuuacaauggcucaucggaaaccaacuuacgaacgugacguugauuugggcgcagguaccagacacgucgccguggagccugaaguggcuaaucucgacauuaucgggcaacgcauugagaacaucaagcacgaacauaaaucaacauggcacuaugaugaggacaaucccuacaagacuugggccuaucauggauccuacgaggucaagccuucuggcagcgcaaguuccaugguuaacggcgugguaaggcugcuaaccaaaccaugggaugugauacccauggucacacagauugccaugaccgacacuacgccuuucgggcagcaacggguguuuaaggaaaaaguugacacaagaaccccaaaggcuaaacagggaacugcacaggugauggaggucaccgcccgcuggcuuugggguuuccugagcaggaauaagaagccccgaaucugcacacgggaagaguuuacgagaaaagugaggucuaacgcagcuaucggcgccguauucguugaugaaaaucaguggaacucagcaaaggaggccguggaggacgaacgcuuuugggaucucguccaccgugagcgggaacugcauaaacaagggaagugugcuaccugcguguacaauaugaugggaaaaagagagaagaaguugggcgaguucgguaaagccaaggggaguagggcgauuugguauauguggcugggagcacgcuuucucgaguucgaggcccuuggcuucaugaacgaagaccacugguuuucccgagagaauagccugucuggcguggaaggggagggauuacaccggcuggguuacauauugagagauaucucgaaaauuccgggcgggaacauguaugcugacgauacugccggaugggacacaaggaucaccgaggaugaccuccagaaugaagcaaagauuacugauaucauggagccugaacaugcucugcuagccacaucaauauucaaacuuaccuaccagaacaaggucguucgcgugcagagaccagcuaaaaauggcacaguaauggacgugaucagccggagggaucaacgugguuccgggcaggucggaacuuauggccugaacaccuuuacgaacauggaggcccagcucauucgacagauggaaagugagggcaucuucucucccagcgagcuggaaaccccuaauuuggcagagcgcguguuagacuggcuggaaaaguacgggguugagagacucaagcggauggcgauuuccggagacgauugcguggucaaaccaaucgacgauagguuugccacagcucuuacugcccugaacgacauggguaaggugcgcaaagauauaccccaaugggaaccgucaaagggcuggaaugacuggcagcagguaccuuucuguagucaccauuuucaccagcuaauuaugaaagaugggagagagaucguugugcccugccggaaccaagacgagcuggucggaagggcacgagugucucagggcgcugguuggagccuccgugaaaccgccuguuuggggaaguccuaugcacagauguggcaacugauguacuuccacagacgcgaucuucggcuggccgcgaaugcuaucugcucagccguuccaguggacugggucccuacaagcaggacuaccuggucuauucaugcacaccaucaguggaugacgacagagaacaugcucuccguguggaauagaguauggauagaagagaaccccuggauggaagauaagacccacgugaguagcugggaggacgucccauacuuaggaaaacgcgaggaccagugguguggcucgcugaucggcuugacugcccgggcuacaugggccaccaauauucagguugcaaucaaccaagugaggcgacugauugggaaugaaaacuaucucgauuacaugacuuccaugaagagauuuaaaaaugacucugaucccgagggagcucuuugguga

SEQ ID NO: 13178 - RNA, 9879 nt, Artificial Sequence
  derived and/or modified CDS sequence (opt3) from DENV-1__AB608786__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaauaugugcacguuaauugccauggaccucggcgagcugugugaagauacuaugaccuacaaaugcccacggauaacggagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugugaucggcaccucgauuacgcagaagggcaucauauucauccucuuaaugcuggucacuccaucacuugccaugcgcugcguggggauuggaagcagagauuuuguagaggguuugaguggcgcuacauggguugacgugguccuggagcacggguccugugugaccacuauggccaaggauaaacccacacuggacaucgaacuccugaagaccgaggugacgaacccugcgguccuuaggaaacugugcauugaagcaaagaucucuaauaccacaacugauagccgguguccaacccaaggagaggccacauugguugaagaacaggacgcuaacuucgugugccgccgaacuuuuguagauagaggcugggguaauggguguggacucuucggcaaaggcucccugauaaccugcgccaaguuuaagugcgugacaaaauuagaggggaagauuguccaguacgaaaaccugaaauauucagugaucguuaccgugcacacuggagaccagcaucaagucgguaaugagaguacggaacacggcacaaccgcaacuauuacaccccaggcuccuacaaccgagauccagcucacugacuacggggcccuuacacuggauuguagcccaaggacgggauuggacuucaacgaaauggugcuacugaccaugaaggagaaaucuuggcucguacauaagcagugguuucuggaucuuccgcugcccuggacuuccggcgcgucaacaagccaagagaccuggaaucggcaggacuugcucguuacauucaaaacugcccacgcaaagaagcaggaaguggucgugcuggguagucaagagggggcuaugcacaccgccuuaacgggcgcuaccgaaauccagacaucuggaacuaccacaauuuuugccggccaucugaaaugccgucuaaagauggauaaacucacucugaaggggauguccuaugucauguguaccgguagcuucaaacuugagaaggaaguggcagagacgcagcacggaacaguuuuggugcagauaaaguacgagggcaccgacgccccuugcaaaaucccauucucgacucaagaugaaaaggggguaacacagaacggacgccugauuaccgcuaaucccaucgucacugacaaagagaagccugugaacauagaagcggagccacccuuuggcgagucuuauauuaucaucggugcaggggaaaaagcccucaagcuguccugguucaagaaaggcucaaguauuggaaagauguuugaggcuaccgccagaggcgcaaggcggauggccauccuuggggauacagcuugggacuucggaagcauugguggcguuuuuacguccguggggaaacugguccaucagauauucggaaccgccuacggcguguuguuuucugguguaagcuggacuaugaagaucgggauuggcgugcuccugacaugguuaggacuaaauucacgaaguaccucccuaagcaugacauguaucgcaguuggccucgucacucuguaccuuggggugauggugcaggcggauucuggaugcgucaucaacuggaaaggccgcgaauugaagugugguucagggauuuucguuaccaaugaggugcacacguggacagaacaauauaaguuucaggcugacaguccgaaaagacugagcgccgcaauaggaaaggccugggaggagggcgugugcgguaucagguccgcuacccggcucgaaaacauuauguggaaacagaucucuaacgagcugaaucauauuuuacuggaaaacgacaugaaguucacuguagucgugggcgauguugccgggauccuugcacagggcaagaagaugauacgcccucaacccauggaguacaaauauucguggaaaagcuggggcaaggcuaaaaucauuggggccgacgugcagaauaccacauuuaucauugauggaccaaacacuccugaaugucccgacgaucagagagcguggaauaucugggaggucgaggacuacggcuucgguauauuuaccacaaacauuugguugaagcucagggauuccuauacacaggugugcgaccaccgucugaugucagccgcuaucaaagauaguaaggcaguucacgccgacaugggguacuggauugaaucugagaaaaaugaaaccuggaagcuagcucgggccagcuucaucgaggugaagacuuguauauggccaaaaucccauacacuguggucaaacggaguacucgaaagcgagaugaucauucccaagaucuauggcgguccuauuucucaacacaauuaccgaccaggcuacuucacccagacugcagggccguggcaucugggaaaacuugaguuggauuuugaccugugcgaaggcacaaccgucgugguggaugagcacugcgggaacagaggacccuccuuaaggacgacuaccgucacaggcaagaucauacacgaaugguguugccgcaguuguacccucccuccacugcgguucagaggugaggacgggugcugguauggaauggagauuaggcccguuaaagaaaaggaggaaaaucuugugaaguccaugguaucugcgggcuccggugagguggacucauuuagucugggcuugcucuguaucagcaucaugauugaagaggucaugcgcucgcgauggucccggaaaaugcugaugacugggacacuagccguguucuuucugcucaucaugggacagcugaccuggaacgaucuuauucguuugugcauaaugguuggcgcuaaugccucugacagaauggggaugggaacaacuuaccuggcauuaauggcuaccuucaagaugaggccuauguuugccgugggccuccuguuccgccggcuuacgagcagagagguccugcuacucacaaucggucugucauugguggcaaguguugaacugccaaacuccuuagaggaacucggggauggacuggccaugggcauuaugauccuuaaacuguugaccgacuuucaaucucaucagcucugggcuacucugcuaagccugaccuucauuaagacaacuuuuucccuucacuaugcguggaaaaccauggccauggugcucucaaucgucagccuguuccccuugugucugaguacgacaucucagaagaccacuugguuaccgguacuccugggcucccuugggugcaagccucugacaauguuuuugauagcagagaauaaaaucuggggaagaaagagcuggccacucaacgaagguauuauggcugugggcaucguuucgauucugcuaucaucucugcuuaaaaacgaugugccccucgccgggccucugaucgccggaggcauguugauagcuuguuacgucauuagugguuccagcgcagacuuaucucuggagaaggccgcggaggugagcugggaagaggaagcugagcauuccggggccucacacaauauccucguagaagugcaggaugacggaaccaugaaaaucaaggaugaggagcgagacgauacucugacaauucuucugaaagcaaccuugcuagccgucaguggcguuuauccccugagcauaccagcuacacucuucgugugguacuucuggcaaaagaagaaacagcgcucuggcgugcugugggacacuccuucacccccagaagucgagcgggcagugcuugaugacgggaucuauagaauuaugcagaggggauuacugggucguagccagguuggcguagggguguuucaagaaaacgucuuccauaccauguggcacgugacacgcggagccguucucauguaccagggcaagcgguuggagccgaguugggcgagcgugaaaaaggaccugaucuccuacggugggggauggagacuccagggcucuuggaauaccggcgaggaaguccaggugauugcuguagagccugggaaaaaccccaagaauguccaaacagccccaggaacuuuuaagacccccgaaggugaggugggcgcaaucgcccuggauuucaaaccugggacgucgggaagcccaauaguuaacagggaaggcaagaucgugggucuuuaugggaauggagucgugacaacuucaggcaccuacguuuccgcuauugcccaggcaaaagcuagucaggagggcccccugccugagaucgaagacgagguguuucgaaagcggaacuugacaauuauggaucuacacccggggucuggaaaaacccgcagauaucugccagccaucgucagggaagcgauaaagcggaagcuccgaacuuuaauucuggcccccaccagagugguagcaagcgagauggcugaagcccuuaaagguaugccuauccgcuaccaaacaacggcugugaaguccgagcauacuggcaaagagaucguugaccugaugugccacgcaaccuucacaaugaggcucuugucaccaguccgugugcccaauuauaacaugauuaucauggaugaagcccauuuuaccgacccuucuagcauagccgcucggggguacauuaguacuagagugggaaugggcgaggcggcagccaucuucaugacagcuaccccgcccgguuccgucgaagccuuuccacagagcaaugcaguaauucaggaugaggaaagggacaucccugagcgcucuuggaacucaggguaugaguggauaacggauuuccccggaaagacugugugguuuguuccauccauuaaaaguggcaaugacaucgccaacugucugcgaaagaauggcaagagagugauccagcucagccggaaaacauucgauaccgaauaccaaaagaccaaaaacaacgacugggacuacgucgugacuacagauauuucggagaugggggcuaauuucagggcggaccgcguuaucgauccucguagaugccugaagcccgugauucuuaaagacggaccagaacgggucauacuagccgguccgaugccugugaccguagcaucugcugcccagaggcgcggccgaaucgggagaaaccacaauaaggagggagaucaguauauuuacaugggccagccccugaacaaugacgaggaucaugcacacuggacagaagccaagauguuguuagacaacaucaauacuccagaggguaucauucccgcucuguuugaaccugagcgggaaaaauccgccgcgauagauggggaguauaggcuccgcggcgaggcaagaaagacguucguggaacugaugaggcggggagaccuuccaguuuggcugagcuacaaagucgccucagagggcuuucaauauagugaucgucgcuggugcuucgacggggaacgaaacaaucaggugcucgaggaaaacauggauguggagaucuggaccaaggagggagaaaggaaaaaguugaggccccgguggcuggacgcucgcacauacucugacccucuagcccugagagaguuuaaagaguucgcugcagguaggcgguccgucagcggcgaucucauucuugagaucgggaagcugccgcagcacuuaacucagcgagcccaaaaugcuuuggacaaccugguuaugcuccauaauucagaacagggaggcagagccuaucgccacgcaauggaggagcugccagauaccauugaaacacuuaugcugcucgcguugaucgccgugcugaccggugggguaacuuuauuuuuccuaaguggcaggggacugggcaagacgagcauagggcuccuuugugugauggcuuccucuguccuguuguggauggccagcguggagccccauuggaucgcagcuuccauuauccuggaauuuuuccucaugguucugcuuauuccugagcccgaccggcagcguaccccacaggauaaccaacucgccuacguggucaucggacuguuguuuaugauacugacaguagcagccaaugagauggguuuacuagaaacuaccaaaaaggaccugggcauugggcacguggcuguugagaaccaccaucacgcggccaugcucgauguggaccuucauccugcaucagcuuggacacuguacgccgucgccaccacuaucauuacacccaugaugagacacacgaucgaaaacaccacugcaaauauaucuuugacagcuaucgccaaccaggcggcuauucugaugggacucgauaaaggcuggccaaucaguaagauggacauuggugugccucugcuugccuuagggugcuauucgcaggucaauccgcugacccucaccgcagccguguugaugcugguugcucauuacgcaaucauaggccccggacuacaagccaaagcgacaagggaggcucagaagcgcacugccgcaggcauuaugaagaacccaacgguggaugggaucguagccaucgaccuggauccuguggucuaugacgcuaaauucgaaaagcagcucggacagauuaugcuucugaucuuguguaccagccaaauacugcucaugcggacaacuugggcccugugcgaguccauuaccuuagcaacaggcccccuuaccacucugugggaggguucuccagggaaauuuuggaauacgacaaucgcuguuucaauggccaacauuuuccgaggaagcuaccucgcgggcgccggucuagcauucucccugaugaagaguuugggcgggggaagaaggggcaccggggcucagggagaaacucugggcgagaaauggaagcgccagcucaaucagcuuucuaagagcgaauuuaacaccuauaaagguucagggaucauggagguggaccgguccgaagccaaggagggacugaaaagaggcgagacaacuaagcacgcagucagucgugguaccgcuaaauugaggugguucguggaacggaaucugguaaagccugagggcaaggugauagaucucggguguggacgcggcggguggagcuacuauugcgccggacuaaagaagguuacagaagugaaaggcuacacgaagggugggcccggacacgaggaaccgaucccaauggccaccuacggcuggaaccuggucaaacuucauucuggcaaggacguguuuuucauuccucccgagaaaugugauacucugcuaugcgacaucggggaguccucaccaaaucccacaauugaagagggacgaacccucagaguccugaagaugguggaaccuugguugagggguaaccaauuuuguaucaagauucugaauccguauaugcccagcguuguagagacucucgagcagaugcagcggaaacacggcgggaugcuugugcgcaacccacugucgagaaauucuacacaugaaauguacugggucaguugcggaaccggcaacaucguguccgcgguuaauaugacgagcaggauguuacugaaccgauucaccauggcucaccggaagccuacauaugagcgugauguggacuugggugcagggacuagacacgucgccguggaacccgagguagcuaaccucgauauaauuggacagcgcaucgaaaauaucaaacaugagcacaagucaaccuggcauuacgacgaggauaacccuuauaaaacaugggccuaccacggcuccuaugaagugaagccaucuggcagcgcaaguuccaugguuaauggggucgugaagcugcuaacuaaacccugggacgugauuccuauggucacccaaauagccaugacagauaccacuccauuuggacagcagaggguuuucaaggagaaaguggacacgcggacacccaaggcuaaaagagguaccgcgcaaaucauggaaguaacugccaaguggcuuuggggcuuucugagccgcaacaagaaaccgaggauuuguacccgagaggaguucacacggaaggugagaucuaaugcagcuaucggggccgucuuuguggacgagaaccaguggaacucagcaaaagaggccguugaagaugagagguucugggaccucgugcaucgcgaacgugagcugcacaagcagggaaaaugcgcuacgugcgucuacaacaugaugggcaagcgggaaaagaaauugggugaguuugggaaggccaaaggaaguagagcgauuugguacauguggcugggcgcaagguuccucgaguucgaagcccuuggcuuuaugaaugaggaucacugguucucccgcgaaaacagccugucugggguggagggagaggguuuacauaagcugggcuauaucuugcgagacauaucgaaaaucccugggggaaauauguacgcugaugacaccgccggcugggauacucggauuacagaagacgaucuccagaacgaggcaaagaucaccgacauuauggaaccagagcacgcucugcuagccaaaucaaucuuuaaacuuacuuaucaaaauaagguaguuagagugcagaggcccgcuaaaaacgguacagucauggaugugauaagccgcagagaccagcggggguccggacaggugggcaccuacggccugaauacauucacuaacauggaagcccaacucauuaggcagauggagagugaggggaucuuuucuccuagcgaacuggagaccccaaacuuggcagaacgugucuuagauuggcuggagaaguauggaguugaacgacucaaacgcauggcgaucuccggugacgacugugugguaaagcccauugaugacagauucgccacggcucuuaccgcccugaaugauaugggcaaagugcggaaggacauaccgcagugggagccuucaaagggguggaacgauuggcagcaaguccccuuuugcagucaucacuuccaccagcuaaucaugaaagacggaagggagauugugguuccaugucgcaaucaggaugaacuggugggcagagcacgggucucucagggugcuggguggagccucagggagacagccugcuugggaaaguccuacgcacaaauguggcagcugauguauuuucaucgacgugaccuuagacuggccgcgaacgcuaucuguucagccgugccuguagauuggguucccacuagccgcaccacauggucuauucacgcacaucaccaguggaugacuaccgaagacaugcucuccguguggaaucgggucuggaucgaggaaaacccauggauggaggauaaaacgcauauaaguagcuggggcgacgugcccuacuuaggcaagagggaggaccaauggugcgggucgcugaucggauugacagccagagcuaccugggccacuaauauucagguugcaaucaaccaggugcgccggcugauugguaaugaaaacuaccucgauuauaugacauccaugaaaagguucaagaaugagucugacccugaaggcgcucuuugguga

SEQ ID NO: 13179 - RNA, 9879 nt, Artificial Sequence
  derived and/or modified CDS sequence (opt3) from DENV-1__AB608787__SS-prME
agcgugacaaugcugcucaugcuuaugcccacagcacuggcuuuccacuugacuacgcggggaggggaaccucauaugaucgucuccaagcaggaaaggggaaaaucuuuacuguuuaagaccucagccgguguuaacaugugcacauugauugccauggaccucggagaacugugugaagauacuaugaccuacaaaugcccacggauuacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagccgggauuuuguggagggucuuaguggcgcgacuuggguagacguuguguuggagcacggguccugugucacaaccauggcaaaggauaaacccacucuggacaucgaacugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacugguagcuucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguuuuuacauccguggggaaacugguccaucagaucuucggaacggcguacggcguguuguuuucugguguaagcuggaccaugaagauugggauaggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccguagucgugggcgauguugcugggauccuugcccagggcaagaagaugauucgcccucaacccauggagcacaaauacucguggaaaagcuggggcaaggcgaagaucauaggggccgacgugcaaaauuccacuuuuaucauugauggaccaaacaccccugaaugucccgacgaucagagagcuuggaauaucugggaggucgaggacuauggcuucgguauuuuuacaacuaacaucugguugaagcucagggauucauacacccaggugugcgaccaccgucugaugagugcagccauaaaagauucuaaggcuguucaugccgacaugggguauuggauugaaagcgagaaaaaugaaacauggaagcuagcacgggcguccuucaucgaggugaagacguguauuuggccaaaaucacacacccuguggagcaacggaguacucgaaucugagaugaucauacccaagaucuacggcgguccuauuucccaacauaauuaucgaccaggcuacuucacucagacagccgggccguggcaccugggaaaacuugaguuggauuuugaccugugcgaaggcaccacugucgugguggaugagcacugcgggaacagaggacccaguuuaaggacaaccacggucacuggcaagaucguucaugaaugguguugccgcagcuguacccucccuccacugcgguucagaggugaggacgggugcugguacggaauggagauuaggcccgugaaagaaaaggaggaaaaucuuguaaagucuaugguguccgcuggcucaggugaggucgacaguuuuagccugggcuugcucuguaucucgauaauuaucgaagaggugaugcgcucccgauggauccggaaaaugcugaugacagggacccuaggaguuuucuuucugcucauuaugggccagcugacuuggaacgaucuuauccguuugugcauuauggugggggccaaugcaucugacagaaugggaaugggcacaaccuaucuggcuuuaauggccacauucaagaugaggccuauguuugcagucggucuccuguuccgccggcuuacuagcagagaggugcugcuacucaccauagggcugucauugguugccaguguggaacugccaaacuccuuagaggaacucggagauggccuggcuaugggcaucaugauucuuaaacuguugacggacuuucaaucucaccagcucugggcgacacugcuaagccugaccuucaucaagacuaccuuuucccuucauuacgccuggaaaacaauggcaaugguccucucaauuguaagccuguuccccuugugucugaguacuaccucucagaagacgacaugguuaccggugcuccuggggucccuuggaugcaagccucugaccauguuuuugaucgcugagaauaaaauaugggguagaaaguccuggccacucaacgaaggcaucauggccguugggauugugucgauccugcuaucaucucugcuuaaaaacgaugucccccucgccggaccucugauugcuggcgguauguugaucgcauguuaugugauaaguggguccagcgccgacuuaucucuggagaaggcggcugagguaagcugggaagaggaagccgagcacuccggagcaucacauaauauucucguggaaguccaggaugacggcacuaugaaaaucaaggaugaggagcgagacgauacacugaccauccuucugaaagccacuuugcuagcuguuaguggcguguacccccugagcauuccagcaacacucuucgugugguauuucuggcaaaagaagaaacagcgcucugggguccugugggacaccccuucacccccagaaguggagcgggccguucuugaugacggaauauacagaaucaugcagagggguuuacugggccguagccagguaggggugggagucuuucaagaaaacguguuccacacgauguggcacguuacucgcggcgcggugcucauguaucaggguaagcgguuggagccgaguugggcuagcgucaaaaaggaccugauuuccuacgggggaggcuggagacuccagggcucuuggaauaccggggaggaagugcagguaaucgccgucgagccuggcaagaaucccaagaaugugcaaacagcaccagguaccuuuaagacacccgaaggcgagguuggggccauugcucuggauuucaaaccuggaacuucgggcagcccaaucgugaacagggaagguaagauagucgggcuuuacggaaauggcgugguuaccacgucaggcacauauguguccgccaucgcacaggcuaaagccagucaggaggggccccugccugagauugaagacgaggucuuucgaaagcggaacuugacuaucauggaucuacauccgggaucugguaaaacccgcagauaccugccagcgauugugagggaagccaucaagcggaagcuccgaacauuaauacuggcacccaccagaguaguggcuagcgagauggccgaagcucuuaaaggcaugccuauucgcuaucaaacuaccgcaguuaaguccgagcacacagggaaagagaucgucgaccugaugugccaugccacguucacuaugaggcucuugucaccagugcgugugcccaauuacaacaugaucauuauggaugaagcccacuuuaccgacccuucuagcaucgcugcgcggggauauauaaguacaagagucggcaugggugaggcagccgcuauuuucaugaccgccacuccgcccggguccguagaagcauuuccacagagcaaugccgugauccaggaugaggaaagggacauuccugagcgcucuuggaacucaggauacgaguggaucacagauuuccccggcaagaccguuugguuugugccauccauaaaagcuggcaaugacauugcgaacugucugcgaaagaaugggaagagagucauccagcucagucggaaaacguucgauacugaauaucaaaagaccaaaaacaacgacugggacuacgugguuaccaccgauaucagcgagaugggagccaauuucagggcagaccgcgugauugauccucguagaugccugaagcccgucauccuuaaagacgguccagaacgggugauucuagcuggcccgaugccuguaacuguggccucggcagcccagaggcgcgggcgaauaggaagaaaccauaauaaggagggcgaucaguacaucuauaugggucagccccugaacaaugacgaggaucacgcucacuggacagaagccaagauguuguuagacaacauuaauaccccagaggggaucauccccgcgcuguuugaaccugagcgggaaaaaucugcagccauugauggcgaguacaggcuccgcggagaggcuagaaagacauucguugaacugaugaggcggggcgaccuuccagucuggcuguccuauaaaguggccagcgagggguuucaauacucagaucgucgcuggugcuucgacggagaacgaaacaaucaggugcucgaggaaaacauggaugucgagauauggacuaaggagggugaaaggaaaaaguugaggccccgguggcuggacgcucgcacguauagugacccucuagcacugagagaguuuaaagaguucgccgcuggcaggcggucuguuuccggggaucucauccuugagauuggaaagcugccgcagcauuuaacccagcgagcccaaaaugcauuggacaaccuggugaugcuccacaauagcgaacagggcgguagagcguaccgccaugccauggaggagcugccagauacaaucgaaacucuuaugcugcucgcuuugauugccguacugaccgggggcgugacauuauuuuuccuaucaggaaagggccuggggaaaaccaguaucggacuccuuugugucauggcaagcuccgugcuguuguggauggcuucuguugagccccacuggauagccgcaagcaucauucuggaauuuuuccucauggugcugcuuaucccugagcccgacaggcagcggacuccacaggauaaccaacucgccuaugucguaauuggucuguuguuuaugauccugacgguggcugcgaaugagaugggcuuacuagaaaccacaaagaaagaccuggggauaggacacguugccguggagaaccaucaccaugcagcuaugcucgaugucgaccuucacccugccuccgccuggacucuguacgcaguggcuaccacaauuaucacccccaugaugcgucauacuauugaaaacacaacggccaauaucucauugaccgcgauagcuaaccaggccgcaauccugaugggccucgauaaggguuggccaauuucuaaaauggacaucggggucccucugcuugccuuaggcugcuacagucaggugaauccgcugacucucacagcugcaguuuugaugcugguggcccacuaugcgauuaucggacccggccuacaagcuaaggccaccagagaggcacagaagaggaccgccgcugggauaaugaaaaacccaacaguagauggaauuguggccaucgaccuggauccugucguuuacgacgcaaaguucgaaaaacagcucggccagaucaugcuucugauuuuguguacuucgcaaauccugcucaugcgcacgaccugggcucugugcgagagcauaacauuagccacugguccccuuaccacacugugggagggguccccaggaaaguuuuggaauaccacuauugcggugucuauggccaacaucuuccggggcucauaucucgcaggagcuggccuagccuucagccugaugaaaucccuagggggaggccgaagagggacgggagcacagggcgaaacacugggugagaaguggaagaggcagcucaaucagcuuaguaaaucugaauuuaacaccuacaaggggagcggaauuauggaggucgaccgcucagaagcuaaagagggccugaagcggggugagacuaccaaacacgccguguccagaggcacagccaaguugcguugguucguagaaaggaaucuggugaagccugaggggaaaguuaucgaucucggauguggcagagggggauggaguuauuacugcgcgggcuuaaagaaagugacugaagucaaggguuauaccaaagggggacccggccaugaggaaccgauaccaauggcuacauacggcuggaaccuggugaaacuucacagcgggaaagacgucuuuuucaucccucccgagaagugugauacgcugcuaugcgacauuggagagucuuccccaaaucccaccaucgaagagggucgcacucuccgagugcugaagaugguugaaccuugguugaaaggcaaccaauuuuguauuaagauccugaauccguacaugcccucaguaguggagacacucgagcagaugcagagaaaacaugggggaaugcuugucaggaacccacugagcagaaauucgacccacgaaauguauugggugucuugcggcacugguaacauuguuagugcagugaauaugacaucccgcauguuacugaacagauucaccauggcccacaggaagccuacguacgagcgagaugucgacuugggggcuggaacccggcauguggccguagaacccgagguggcaaaccucgauaucauaggccagcguauugaaaauaucaaacacgagcauaagagcacauggcacuaugacgaggauaacccuuacaagacuugggccuaucauggcucauacgaaguuaaaccauccgggucugcuagcaguauggucaauggaguggugaagcugcuaaccaaacccugggacgucaucccuaugguuacacaaauugcgaugacugauaccacaccauuuggucagcagagaguguucaaggagaaaguagacacccgcacucccaaggccaagaggggcacggcacaaauaauggaagugacagcucgguggcuuugguccuuucugagcagaaacaaaaagccgcgcaucuguaccagggaggaguucacucgaaaaguccggucuaaugccgcaauuggggccguguuuguugacgagaaccaguggaacucagcuaaggaggccguggaagaugagagauucugggaccucguccacagggaacgcgagcugcacaaacagggaaagugcgcgaccugcguguauaacaugaugggcaagcgugagaaaaaguugggugaguuugggaaagcaaagggaagucgggccaucugguacauguggcugggcgcuagauuccucgaguucgaagcccuuggcuuuaugaaugaggaucauugguucuccagggaaaacagccugucugggguagagggagaggguuuacacaaacugggcuacauuuugcgcgacaucucgaagauaccugggggaaauauguaugcagaugacacagcuggcugggauacgcgaaucaccgaagacgaucuccagaacgaggccaaaauuacugacaucauggaaccagagcaugcucugcuagccaagucaauuuuuaaacuuacauaccaaaauaaaguugugcggguccagagacccgcaaagaacgguaccgugauggaugugaucagcaggcgcgaccagagaggguccggacaggucggcacuuauggccugaauacauucaccaacauggaagcgcaacucauacggcagauggagagugaggggauauuuucuccuagcgaacuggagacaccaaacuuggccgaaaggguuuuagauuggcuggagaaauacggaguggaacgucucaagcgaauggcuaucuccggugacgacuguguagugaaacccaucgaugaccgcuucgccacugcacuuaccgcucugaaugauaugggcaaggucagaaaggacauuccgcagugggagccuucaaaaggguggaacgauuggcagcaagugcccuuuugcagucaccacuuccaucagcuaauaaugaaggacggacgggagaucguugugccauguaggaaucaggaugaacuggucggccgcgccagagugucucagggugcaggguggagccuccgggagacggccugcuugggaaaauccuaugcgcaaauguggcagcugauguacuuucacaggcgagaccuucgucuggcugccaacgcaauuuguucagccguaccuguugauugggugcccaccagcagaacaacuuggucuauccaugcucaccaucaguggaugaccacagaagacaugcucuccgucuggaaucgcguguggauugaggaaaacccauggauggaggauaagacucacaucaguagcugggaggacguucccuauuuaggcaaacgggaagaccaauggugcggcucgcugauaggguugaccgccaggccuacgugggcaacaaauauccagguggcuauuaaccaggucagacgccugaucggaaaugagaacuaccucgauuacaugaccuccaugaagcgguucaagaaugaaucugagccagagggugcccuuugguga

SEQ ID NO: 13180 - RNA, 9879 nt, Artificial Sequence
  derived and/or modified CDS sequence (opt3) from DENV-1__HE795086__SS-prME
agcgugacaaugcugcuaaugcuuaugcccacagcacuggcuuuccacuugacuacgcgaggcggggagccucauaugaucgucuccaagcaggaaaggggaaaaucuuuacuguuuaagacaucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguguaaggucugcaacgcgguuggaaaacauaauguggaagcagaucucgaacgagcugaaucauauucuccuggaaaacgacaugaaauuuacagucgugguuggcgauguggcugggaucuuagcccagggaaagaaaaugauucgcccucagcccauggaguacaaguauagcuggaaguccuggggcaaagcgaagaucauaggggccgacguccaaaauaccacuuucaucauugauggaccaaacaccccugaaugucccgacgaucagagagcuuggaauaucugggagguggaggacuacggcuuugguauuuucacaacuaacaucuggcugaaacuuagggauucauauacccagguuugcgaccaccguuugaugagugcagccauaaaggauucuaaagcugugcacgccgacaugggguacuggauugaaagcgagaagaaugaaacauggaagcucgcacgggcguccuucaucgagguaaaaacguguauuuggccaaagucacauacccuguggagcaacggaguccuagaaucugagaugaucauacccaaaaucuauggcgguccuauuucccagcacaauuaccgaccaggcuacuuuacucaaacagccgggccguggcaucugggaaagcucgagcuggauuucgaccuuugcgaaggcaccacugugguggucgaugagcacugcgggaacagaggacccaguuugaggacaaccacgguuacuggcaaaaucauucacgaaugguguugccgcagcuguacccugccuccauuacgguuuaagggugaggacgggugcugguauggaauggagaucagacccgugaaggaaaaagaggaaaaucucguaaagucuaugguguccgcuggcucaggugaggucgacaguuucagccugggccuucuguguauaucgauuaugaucgaagaggugaugaggucccgcuggucucgaaaaauguugaugacagggacccucgccguauuuuuccugcuaaucaugggacagcugacuuggaacgaucucauucggcugugcaucauggugggcgcaaaugcuagcgaccguauggggaugggaacaaccuaccuugccuugauggcaacauuuaagaugagaccuauguucgccgucggccuguuauuuaggcgccucacuucacgggaggugcugcuucugaccauuggucuaagucucguugcuuccguggaacugccaaacucuuuggaggaacugggggauggauuagcgaugggcauaaugauccucaaacugcuuacggacuuccagagccaucaacugugggccacauugcucucccugaccuuuauuaagacuaccuucucacuacacuaugcauggaagacaauggcuaugguccugagcaucguaagucuuuuuccccucugucugucuacuaccucccagaaaacgacaugguugccggugcuguuaggcagccucgggugcaagccucugaccauguuccuuauugccgagaauaaaaucuggggaagaaagucguggccacugaacgaagguauaauggccguuggcaucgugucaauuuugcucucuagucugcucaagaaugaugucccccuggcugggccucuuaucgcaggaggcaugcucauugccuguuacgugaucuccgguagcucugcggaccugagcuuggagaaggcugccgagguauccugggaagaggaagcagagcauucaggggccagucacaauauauuaguggaaguccaggaugacggaacuaugaaaauuaaggaugaggagagggacgauacacugaccauccuccugaaggcuacucuucuggcaguuagcggcguguaucccuugucuaucccagccacacuauucgugugguacuuuuggcagaaaaagaaacaacgauccggcguccugugggacaccccuucacccccagaaguggagcgcgcgguucucgaugacgggauuuaucggauaaugcagagaggacugcuugguaggagucagguaggcgugggggucuuccaggaaaacguguuucauacgauguggcacguuacucguggagcuguguuaauguaccaaggcaagcgccuggagccgagcugggccuccgucaaaaaggaccucaucucuuacggugggggauggcgguugcagggcucguggaauaccggcgaggaagugcagguaauugcagucgagccugggaagaaccccaaaaaugugcagacagccccaggaaccuucaagacaagcgaaggugagguuggcgcuaucgcccuggauuuuaaacccgggacuucaggauccccuauugugaacagagaaggcaagaucgucggucucuaugggaauggagugguuaccacgaguggcacauacgugucugcaauagcucaagccaaagcgagccaggacggcccacugcccgagaucgaggaugaagucuucaggaagcgaaaccuuacuauuauggaccugcacccuggguccggaaagacccggcgcuauuugccggccaucgugagagaggcaauuaaaaggaagcuacggacacugauccucgcuccaacccgaguaguggccucagaaauggcugaggcauuaaaagguaugcccauaagauaccagacuaccgccguuaagucugaacauacaggcaaagagauugucgaucugaugugccacgccacguuuacuaugcgccuucugagcccugugagggugccaaauuauaacaugaucaucauggacgaggcucauuucaccgaucccaguuccauugcggcacguggguacaucagcacacgggucggaaugggcgaagccgcugccauauuuaugaccgcaacuccuccggguucuguagaggccuucccccaaucaaaugcugugauucaggacgaagagagagauaucccagaaagguccuggaacaguggguaugaguggauuacagacuuuccuggaaagaccguuugguucgugcccagcaucaagucgggcaaugauauagcgaacugucuccgcaaaaauggcaagcgagucauucaguugucuagaaaaacguucgacacugaguaccagaagaccaagaacaacgacugggauuacgugguuaccaccgacaucuccgaaaugggggccaauuuucgggcagauagggugaucgacccacgccguugccugaagccugucauucucaaggauggacccgagagagugauccuggcugguccaaugccgguaacuguggccagcgcagcccaacggaggggccgcauugggcgaaaccacaauaaagaaggagaccaguauauauacaugggccagccucuuaacaaugaugaggaccaugcucacuggacagaggccaagaugcuacuggauaacaucaauacccccgaagguauuaucccagcguuguucgagcccgaaagagagaaaucagcagccaucgacggggaauaucgguuaaggggcgaggcucgcaagacauuuguugagcugaugagaaggggagaucucccugucuggcugaguuacaaaguggccucugaaggcuuccaguauuccgaccggcguuggugcuuugauggggagcgcaacaaucaagugcuugaagagaacauggacgucgaaauuuggacuaaggagggagagaggaaaaagcugagaccaagauggcucgacgcucggacguacagcgaucccuuggcacugcgcgaguucaaggaguuugccgcugguagaaggucaguuaguggcgaccuaauacuggaaaucgggaaacucccucagcaccuuacccagcgggcccagaaugcacuggauaacuuagugauguugcauaauagcgagcaaggaggccgagcguauagacacgccauggaagaacugccggacacaauugagacucucaugcugcuugcucugaucgccguacucaccgguggggugacauuguucuuucuguccggccgcggauuaggcaagaccucuauugggcuacugugugucauggcaagcuccgugcuccuuuggauggcuucaguugaaccacauuggaucgccgcaucuauaauccuggaguucuuuuugauggugcugcucauucccgaaccugauaggcagcggacuccccaggacaaccagcuggccuacgucguaaucggacuucucuucaugauucugacgguggcugcgaaugagauggguuugcuggagaccaccaaaaaggauuuaggcaucgggcacguugccguggaaaaccaccaucacgcagcuaugcuagacgucgaucugcauccagccagugccuggacucucuacgcaguggcuaccacaauaauuaccccuaugaugcgucacacuaucgagaacacaacggccaauauuucgcuuaccgcgaucgcuaaccaagccgcaauacugaugggauuggacaaaggcuggcccaucagcaagauggauauuggugucccacugcucgcccuggggugcuauucccaggugaauccucuuacuuuaacagcugcaguucugaugcucguggcccauuacgcgaucauuggcccgggauugcaggcuaaggccaccagagaagcacagaaaaggaccgccgcuggcaucaugaagaaccccacaguagacgggauaguggccauugaucuggacccagucguuuaugacgcaaaauuugagaagcagcuaggacagaucaugcugcucauccuuuguacuucucagauucuguugaugcgcacgaccugggcucugugcgaaucaaucacacucgccacuggcccucugaccacauuaugggaggguagccccgggaaauucuggaauaccacuauagcgguguccauggccaacauuuuccggggaaguuaccuugcaggcgcuggucuggccuuuucucucaugaaaagccuaggcgggggacgaagaggcacgggggcacaaggagagacacugggcgaaaaguggaaaaggcaguugaaucagcugucaaaguccgaguucaacaccuauaaacgcagugguaucauggaagucgaucggagcgaggcuaaggaagggcucaaaagaggagagacuaccaagcacgccgugucucguggcacagccaaacuuaggugguuuguagagcggaaucuggugaaaccagaagguaagguuauugacuugggcugugggcgcggaggcugguccuacuauugcgcggggcugaaaaaggugacugaggucaaaggauacaccaagggcgguccugggcacgaggaacccaucccgauggcuacauacggauggaaccucgugaaauuacauucaggcaaggaugucuucuuuauaccaccugaaaagugugacacgcugcuuugcgauaucggcgagagcucgcccaauccaaccauugaggaagggcgaacucugagagugcuaaaaaugguugagcccuggcucaggggaaaccaguucuguaucaagauucugaauccuuauaugccgucuguaguggaaacauuggagcaaaugcagcggaaacacgguggcaugcugguccgcaacccccucaguagaaauuccacccaugagauguacugggugagcugcgggacuggaaacaucguuucagcagugaauaugacauccaggaugcuucugaaccgauuuaccauggcccaccggaagccaacguaugaacgugacgucgauuuaggcgcugguaccagacacguggccguagagccugaaguggcaaaccuggacauuaucgggcagcgcauagagaauauuaaauacgaacauaagucuacauggcacuaugaugaggacaaccccuacaagacuugggccuaucauggaagcuacgagguuaaaccuaguggcuccgcuagcucuauggucaauggcguggugaaguugcucaccaaaccaugggaugucauccccaugguuacacagaucgcgaugacugacaccacaccuuucgggcaacagaggguguuuaaggaaaaaguagacacccggacuccaaaggccaagagaggaacggcacagauuauggaggugacagcuaaauggcugugggguuuccuaucacgcaacaagaaacccaggauauguacccgagaagaguuuacucggaaggucagaaguaaugccgcaaucggcgccguguucguugaugaaaaccaauggaacuccgcuaaagaggccguggaggacgaaagguuuugggaucuuguccaccgcgagcgugaacugcauaagcaggggaagugcgcgaccugcguguacaacaugaugggaaaacgggagaagaaacucggcgaguucgguaaggcaaaagggagcagagccauuugguauauguggcugggagcuagguucuuggaguuugaggcccugggcuucaugaaugaagaccacugguuuucucgcgagaacucgcucucaggcguagaaggggagggacuucacaagcuggguuacaucuuacgagauauuagcaaaaucccgggcgggaauauguaugcagacgauacagcuggaugggacacgcggauaaccgaggaugaccugcagaacgaagccaagaucacugauauuauggagccugaacaugcuuugcucgccaaguccaucuucaaacugacauaccagaauaagguugugagaguccaaaggccagccaaaaacggcaccgugauggacgugauuagucgcagagaucagcgggguucugggcaggucggaacuuauggccuaaauacauuuaccaacauggaggcgcagcuuaucaggcaaauggaaagcgagggcauauucucccccucagagcuggaaacaccuaaccucgccgggcguguucuggacugguuggagaagcacggaguggaacgauuaaaacgcauggcuauuaguggugacgauuguguagugaagccaaucgacgauagauuugccacugcacugaccgcucucaaugacaugggcaagguccggaaagauaucccccagugggagccgucuaagggguggaacgacuggcaacaggugccuuucugcagccaucacuuucaccaacuuauuaugaaagauggaagggaaauaguugugcccugucgcaaucaggacgagcuggucggcagagcccgggugucccagggugcaggguggucacuaagggagacggccugccugggaaagagcuacgcgcagauguggcaacucauguauuuccaucgacgugauuugagacuggcugccaacgcaaucuguucugccguaccaguugacugggugccuaccucccgcacaacuuggaguauucacgcucaucaccaguggaugaccacagaagauaugcuuagcgucuggaaucggguguggaucgaggaaaaccccuggauggaggacaaaacucauauuucguccugggaagacguuccauaccugggcaagagggaggaucaguggugcggcucucucaucggguuaaccgccagagcaacgugggcuacaaauauacaaguggccaucaaccagguccgccggcugauuggaaaugagaacuacuuggacuauaugaccucaaugaagagguuuaaaaaugaaagcgaucccgagggugcgcugugguga

SEQ ID NO: 13181 - RNA, 9879 nt, Artificial Sequence
  derived and/or modified CDS sequence (opt3) from DENV-1__AB189120__SS-prME
agcgugaccaugcugcucaugcuucugcccacaguauugacuuuccacuuaacgaccagaggcggggaaccucauaugaucguuuccaagcaggaaaggggaaaaucucuguuauuuaagacaucagccggugugaauaugugcacucucauugcuauggaccugggcgaacuuugugaugacaccaugacauacaaaugcccgcggauaaccgaaacugaaccggaugacguagauuguuggugcaaugcaacagaaaccugggugacguaugggacuuguagucaaaccggagagcaccgccgagacaagcguagcgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaauagagauuuuguagaggguuugagcggcgccaccuggguugacgugguccuggagcacgggaguugugugacuacaauggcuaaggauaaacccaccuuggacaucgaacuccugaagacggaggugaccaauccugccguccuuaggaaacugugcauugaagcgaagaucuccaacacaacuaccgauucucgguguccaacacaaggagaggcaacuuugguugaagaacaagacgccaauuucgugugccgccgaaccuuuguagauagaggcugggguaacggguguggacucuucggcaaaggcagccugauaacaugcgcuaaguuuaagugcgugaccaaauuagaggggaagauuguccaguacgaaaaucugaaauauuccgugaucguuacugugcacacgggagaccagcaucaagucgguaacgagacaaccgaacacggcacuauugccaccaucacaccccaggcaccuaccucagagauccagcucacugacuacggggcucuuacacuggauuguaguccaaggacgggauuggacuucaaugaaauggugcuacugaccaugaaggagaaaagcuggcucguacauaagcagugguuucuggaucuuccgcugcccuggacuucuggcgccuccacaucacaagagaccuggaaccggcaggacuugcucguuacauucaaaacugcgcacgccaagaagcaggaagcagugguccuggguagccaagagggggcuaugcacaccgccuuaacgggcgcuaccgaaauucagacaaguggaacuaccacaauauuugccggccaucugaaaugccgucuaaagauggauaaacucacucugaaggggaucucuuaugugauguguaccggauccuucaaacuugagaaggaagucgcagagacgcagcacgguacaguguugguucaggugaaguacgagggcaccgacgccccuugcaaaauuccauucagcucgcaagaugaaaaggggguaacucagaauggacgccuggucacagcuaaccccaucgugaccgacaaagagaagccuguuaauauagaagcggagccacccuuuggcgagucuuauauuguggucggugcaggggaaaaagcccucaagcuguccugguucaagaaaggcucaaguaucggaaagauguuugaggcuacugccagaggcgcaaggcggauggccauccuuggggauaccgcuugggacuucggaagcauugguggcguguuuacauccguagggaaacuggugcaucagaucuucggaacggccuacggcguuuuguuuucuggugucagcuggaccaugaagauugggauaggcauccuccugacuugguuaggacugaacucacgaaguacaucccuaagcaugaccuguauugcagugggcauggugacacucuaccugggggucaugguucaggcggauucuggaugcgugaucaauuggaaaggccgcgaacuuaagugugguucagggaucuucgugacuaacgagguacacaccuggacggaacaauauaaguuucaggcugacaguccgaaaagauugagcgccgcaauuggaaaggccugggaggagggcgucugcgguauaagguccgcuacacggcuggaaaacaucauguggaaacagauuucuaaugagcucaaccauauccuguuagaaaaugacaugaaguucaccgugguugugggcgaugucucggggauucuggcccagggcaagaaaacuauccgcccucaacccauggagcacaaauacagcuggaaguccuggggcaaggcaaaaauaaucggggcugacgugcagaacaccacauuuauuaucgauggaccaaauacuccugaaugucccgacgaucagagagccuggaacauuugggagguugaggacuauggcuucgguaucuuuaccacaaauauauggcuuaaguugagggauucauacacacaggugugcgaccaccgucucaugagugcggccauuaaagauucuaaggcuguacaugcagacaugggguauuggaucgaaagcgagaaaaacgaaaccuggaagcuggcccgggcuuccuucauugaggucaagacuuguguguggccaaaaucacacacacuauggagcaauggagugcuggaaucugagaugaucauacccaagaucuacggcgguccuauuucccaacauaacuaucgaccaggcuacuucacccagacugccgggccguggcaccucggaaaacuggagcuugauuuugacuugugcgaaggcacaaccgucguuguggaugagcacugcgggaauagaggacccagucugaggacgacuaccguaacaggcaagaucauucaugaaugguguugccgcagcuguaccuuaccuccacuccgguucaaaggugaggacgggugcugguacggaauggagaucagacccgugaaggaaaaggaggaaaaccuggucaaaucuaugguguccgcaggcucaggugagguugacaguuuuagccuuggccuguuguguauaucgauuaugaucgaagaggugaugaggucccgcuggucucgaaagaugcucaugacugggacacuggucguguuccuacugcucacccugggacagcuuacauggaaugauuugauccggcugugcauuaugguuggcgcgaacgccagcgacaauauggggaugggaacuaccuauuuagcucucauggccacguuucguaugagaccuauguucgcagugggccugcuuuuuaggcgccugacaucacgggagguccuacuccugaccguagguuugagucugguggcuuccguugaauuaccaaacucucucgaggaacugggggauggacuugccaugggcaucaugauucugaaauugcucacugacuuccaaagccaccagcugugggcaacccuacugucccuuacauuugugaagacuacccucucacugcauuacgccuggaaaacgauggcuaugauauugagcaucgucagucuguuaccccucugucugucuacaaccucccagaagacuacauggcuuccggugcuguugggcagccucgggugcaagccucugaccauguuccuaauuacugagaacaaaaucuggggaagaaagucguggccacugaaugaagguauuauggcgguaggcaucgugucaauacuucucucuagucuguugaaaaacgauguccccuuagccgggccucugaucgcaggaggcaugcucauugcuuguuauguuaucuccgguagcucugccgaccugagccuugagaaggccgcuaaaguguccugggaggaagaggcagaacacucaggggccagucauaauauucugguggagauccaggaugacggaacaaugaagauaaaagaugaagagagggacgauaccauuacgaucuugcuaaaggcgacucugcucgcuaucagcggcgucuaccccaugucuauuccagccacccuguuugugugguauuucuggcaaaagaaaaagcagcgauccggcguucuuugggacacaccuucacccccagagguagaaaaagcaguguuagaugacgggauauaccgcauccugcagcggggacucuuggguagaagucaggucggcguggggguuuuucaagagggaguguuccacaccauguggcacgucacaaggggcgccgugcugauguaucaggguaagcgucucgaaccgagcugggcuuccgucaaaaaggaccugauuucuuacgggggaggcuggcgcuuccagggcucguggaacacuggggaggagguccaggugaucgcaguugaaccuggaaagaaucccaaaaacgugcaaaccgccccagguacguuuaagacaagcgagggcgaagucggggcgauugcucuugauuucaaacccggaacuucaggcuccccuaucgugaaucgggaggguaagauaguugggcuguacggaaacggcguggucaccacaaguggcaccuaugugucugccaucgcacaggccaaagcuagccaggaagggccauugcccgagauugaggacgaaguauuuagaaagaggaaucuaacuaucauggaucugcauccuggauccgguaagacccgacgguaccucccggccauugugcgcgaggcaaucaaaagaaaguuaaggacacugguucuugcuccaacgcgggucguggccucagaaauggcggaggcccugaaaggcaugcccauacgauaucaaacuaccgcagugaagucugaacacacagggaaagagauugucgaccucaugugccaugcuaccuucacuaugagauugcugagcccuguacgcgugccaaacuacaauaugaucaucauggaugaggcccacuuuacagaccccgcuaguauugcagccaggggauauaucuccacccguguuggcaugggugaagccgcugcgauauucaugacggcaacuccuccggggagcguggaggccuuuccccagucuaacgcugucauucaggaugaagagaaggacaucccagaacggucauggaacuccggauacgauuggauuacagacuucccuggcaagaccgugugguuuguucccaguaucaaaagcggcaacgauauagccaauugucucagaaagaacgggaaaagggugauucagcugucgcgcaagaccuucgacacugaguaucagaaaacgaagaacaaugacugggauuacgucgugaccacagacaucucugagaugggagcaaacuuucgagccgauagaguaaucgacccacggaggugccuuaagccugugauucuaaaagauggucccgaacgcguuauccuggcuggcccaaugccggucacuguggcguccgccgcacagcguagagggcggauuggaaggaaucagaacaaggagggcgaccaguacauauauaugggucaaccuuugaauaacgaugaagaccaugcucacuggacggaggccaaaauguuacuggauaauaucaacacccccgaggggauuaucccagcacucuucgaacccgagcgcgaaaagagcgccgcuaucgacggcgaguaccgacugagaggagaagcccggaaaacauucguggagcuuaugaggcgcggcgaucugccugucuggcucucauauaagguugcgagugagggguuucaguacucugacagaagguggugcuucgauggagaacggaauaaccagguguuggaggaaaauauggacguagagauuuggacuaaagaaggugagcguaagaagcugcgcccacgauggcuagacgcaagaaccuauuccgauccccuggcccucagggaguuuaaagaguucgcugccggccggcgcagcgugucaggggaccuuauacuggagaucggaaaguuaccucagcacuugacacaaagagcucagaacgcacuggauaaucucgucaugcugcauaacagugaacagggcgguaaagccuacaggcacgcuauggaggaacuuccggacaccauugagacuaucaugcugcucgccuugauugcagugcugaccgggggaguuacguuauuuuuccuaagcggacggggccuggggaagacauccaucggacuccuuugugugaugucuagcuccgcgcuguuguggauggccucagucgagccacauuggauagcugccucuaucauucuggaauuuuuccucaugguacugcuuauccccgagccugaucgacagagaacuccccaagacaaucagcucgcauaugugguuauuggucuguuguuuaugauccugaccguggcugccaacgaaaugggcuuacuagagacaaccaaaaaggaucuggggauaggacacgcagccgcugagaaccaccaucacgcggccaugcucgacgucgaucuucauccagcaagugcuuggacucuguacgccguggccacaacgauuaucaccccuaugaugcgccacacuauugaaaauacaaccgcaaacaucucguugaccgcuauagccaaucaggcggcuauccugaugggccucgacaaggguuggcccauuagcaaaauggauaucggggucccacugcuugccuuaggcugcuacucccaagugaacccucugacacucacugcagccguuuugaugcugguggcucauuaugcaauuaucggaccgggccuacaggccaaggcgacgagggaggcucagaaacggaccgccgcagggauaaugaagaaucccacaguagacggaauuguggccaucgaucuggacccagucguuuacgacgcuaaauucgaaaagcagcucggccaaaucaugcuucugauuuuguguacuucucagauccugcucaugcguaccacaugggcccugugcgagucaauaaccuuagcaacugguccucuuacgacacugugggaagggagccccggaaaguuuuggaacaccacuauugcuguguccauggccaauaucuucagaggcaguuaucucgcgggugccggccuagcauuuucucugaugaaaagccuagggggaggcaggcgcgggaccggagcucagggcgagacacugggugagaaguggaaacggcagcucaaccaacuuucaaaguccgaguucaauacuuacaaacgaagugggauuaucgaggucgauagaagcgaagccaaggagggacugaagaggggcgaaaccacaaaacacgcagugucucgcgguacggcuaaguugcggugguucguagagagaaaccuggugaaaccagagggcaagguuauagaccucggguguggacguggcgggugguccuauuacugcgccggacuaaagaaggugaccgaagucaaaggcuauacuaagggugggccuggacacgaggaacccaucccgauggccacauacggcuggaaucuggugaaacuucauucaggcaaagaugucuuuuucauuccaccugagaagugugacacccugcuaugcgauaucggggaaagcucgcccaacccaacuauugaggagggaaggacacuccgggugcugaaaaugguugaacccugguugcgcgguaaucaguuuuguaucaagauucugaacccuuacaugccgucuguaguggagacccucgaacagaugcagcgaaaacacggcgggaugcuugucagaaauccccugaguaggaacuccacgcaugagauguauugggugagcugcggaaccggcaauaucguuucagcggugaacaugacaucccggauguuacugaaccgcuucacuauggcucacagaaagccaaccuacgagagggacgucgauuugggugcagggacacgacacguggccguagaaccugagguggcuaaucucgacauaauuggacaacggaucgaaaacaucaagaaugagcauaaaucuacuuggcacuaugaugaagacaaccccuacaagaccugggccuaucauggcagcuacgagguuaaaccuaguggcuccgcaagcucuauggucaaugggguggugcgucugcuaacaaagccaugggaugucauucccaugguuacccagauagccaugacugacacgacaccuuuuggacagcaaagaguguucaaagagaagguagacacccgcacuccaaaggcuaaaagggguaccgcgcagaucauggaagugacagccaaguggcuuuggggcuuucugucacggaacaaaaagcccagaauuuguacgcgcgaggaguucaccaggaaaguccgaaguaaugcagcuaucggggccguguuuguugaugagaaccaguggaacuccgcaaaggaagccguggaggacgagcgguucugggaucucgucagaagggaacgcgagcugcacaagcagggaaaaugcgcuacuugcguguauaacaugaugggcaagcgugagaaaaaguugggugaguuugggaaagccaagggaagccgggcgauuugguacauguggcugggcgcaagauuccucgaauuugaggcccuuggcuucaugaaugaggaccauugguucucuagggaaaacucgcugucagggguagagggagaagguuuacacaaacugggcuacaucuugcgcgauauaagcaagaucccagggggaaauauguaugcugacgauacagccggcugggacacccgaauuacugaggaugaccuccaaaacgaggcaaagaucacagauauuauggaaccugagcacgcucugcuagccaccuccaucuuuaaacuuacauaccagaauaagguugugcggguccagagaccagcuaaaaacgguacugugauggacgugauaaguaggcgcgaucagagagggucuggacaagucggcaccuauggccugaacacguucaccaauauggaagcccagcucauucggcagauggagagcgaagggaucuuuucccccucagagcuggagacaccuaacuuggcaggaaggguuuuagacuggcuggaaaagcaugguacugagcgucuccgacgcauggcgaucaguggcgacgauugugugguaaaaccaauugacgauagauucgccaccgcucuuacagcccugaaugacauggggaagauacggaaggauaucccccagugggaaccgucuaaaggauggaacgacuggcaacaggugccuuuuugcagccaccauuuccaccagcuaauuaugaaggauggcagggagaucgucgugcccugucgcaaucaggacgaacugguugguagagcacgggugucccaaggggcuggauggucacucagggagacugccugcuugggcaaaagcuacgcacagauguggcagcugauguauuuucaccgacgugaucuuagacuggccgcgaacgcuauuuguucugccgucccaguggacuggguaccuaccucccgcacgacauggaguauccaugcacaccaucaauggaugaccacugaggauaugcucagcguuuggaaucggguguggauagaagagaaccccuggauggaagacaagacacacgucucguccugggaggacgugccauacuuaggcaaaagggaagaucaguggugcgggucucugaucggauugaccgccagagcuacuugggccaccaauauucagguugcaaucaaccaggugcgccggcugauugguaaugagaacuaucucgacuacaugacaucaaugaagagguucaagaaugagagcgaucccgaaggcgcucuuugguga

SEQ ID NO: 13182 - RNA, 9879 nt, Artificial Sequence
  derived and/or modified CDS sequence (opt3) from DENV-1__AB189121__SS-prME
agcgugaccaugcuguucaugcuccuucccacggcccuggcuuuucacuugacuacgagaggaggggaaccucauaugaucgucuccaagcaggaaaggggaaaaucuuuacuguucaagaccucagccgguguuaauaugugcacauugauugccauggaccucggagaacugugugaagauacuaugaccuacaaaugcccacggauaacagaaaccgaaccggacgauguggacuguuggugcaaugcgacugaaacauggguaaccuaugggacguguagucaaacuggagagcaccgccgagauaagcguagcguggcucuugcaccccaugucggccuggguuuggaaaccagaacagagacuuggauguccucugaaggggcauggaggcagauccagaaaguggagaccugggcccuccggcacccuggauuuacaguuauggcucuguuccuggcacaugccauuggcaccucgaucacgcagaagggcauuaucuuuauacucuuaaugcuggugacuccaucaauggcuaugcgcugcgucgggaucggaaauagagacuucguggagggucuuagcggcgccacauggguagauguuguguuggaacacgggaguugugucaccacuauggcgaaggacaaacccacacuggauauugagcuacucaagaccgaagugacgaauccugcagugcugaggaaacuuugcaucgaggccaagauuuccaacaccacaacugacucucgguguccaacccaaggagaagcuacacuggucgaggagcaggauacuaauuuuguuugccgccgaaccuucguggacagaggcugggguaacggguguggauuguuuggcaaaggcagccucaucacaugcgccaaguucaagugcguaaccaaacuggaagggaagauagugcaguacgagaauuuaaaauauuccgucauugugacuguucacacgggagaucagcaucaaguggguaacgaaacaaccgagcacggcacuaccgcaaucauuacaccccaggcuccuaccucagaaauccagcugacugacuacggggcccucacacuugacuguaguccaaggacgggacuggauuuuaaugagauggucuugcuaaccaugaaggagaaaagcuggcuggugcauaagcagugguuccucgaccugccgcuucccuggacuucuggcgcguccacaucacaagaaaccuggaaccggcaggaucuguugguaacauuuaaaacugcccacgcaaagaagcaggagguugugguccucgguagccaagaaggggcuaugcacaccgcccugacgggcgcuaccgagauccagacaaguggaacuaccacaauuuucgccggccauuuaaaaugccgucugaagauggacaaacuaacucucaagggggugucuuaugucauguguaccggauccuucaaacuggaaaaggagguggcagagacgcagcacgguacaguucuugugcagguaaaguacgaaggcaccgaugccccuugcaaaauaccauuuagcucgcaagacgagaagggggucauccagaauggacgcuugauuacugcuaaccccaucgugacagauaaagaaaagccuguuaauauagaggcggagccacccuucggcgaaucuuauauuguggucggugcaggggagaaagcccugaagcucuccugguuuaagaaaggcucaaguaucggaaagauguucgaagcuaccgccagaggcgcaaggcggauggccauccugggggacacugcuugggauuuuggaagcauugguggcguguucaccuccguagggaaacuugugcaucagaucuuuggaacagccuacggcguucuguucucuggugucagcuggacgaugaagauugggauaggcaucuugcucaccuggcugggauuaaacucacgaaguacuucccugagcaugacauguauugcagugggcauggugacccuauaccucggggucaugguucaggcggacucuggaugcgugaucaauuggaaaggccgcgagcugaagugugguucagggaucuuugugacaaacgaaguacacacuuggaccgagcaauauaaguuccaggcugauaguccgaaaagacuuagcgccgcaauuggaaaggccugggaggaaggcgucugcgguauaagguccgcuacgcgguuggagaacaucauguggaaacagauuucuaaugaacugaaccauauccuccuggagaaugacaugaaguuuacagugguugugggcgacgucucggggauuuuagcccagggcaagaaaaugauccgcccucaacccauggaacacaaauacagcuggaaguccuggggcaaggcaaaaauaaucggggcugaugugcagaacauuaccuucaucauugacggaccaaauacuucagaguguccugauaaccagagagccuggaauaucugggagguugaagacuauggcuuugguauauucaccacaaacauuuggcugaaacuuagggauaguuacacucaggugugcgaccaccguuugaugucugcggccaucaaagauagcaaggcuguacaugcagacaugggguauuggauugaguccgagaagaaugagaccuggaagcucgcccgggcuucauucaucgaagucaagacauguauauggcccaaaagccacacgcuguggucuaacggagugcuagaguccgagaugaucauuccaaagaucuacggcggucccgugagucaacauaauuaucgaccuggcuacuuuacccagacugccgggccauggcaccugggaaaacucgaacuggauuucgaccuuugcgagggcacaaccgucguuguggaugaaaacugcgggaauagaggaccgagcuugaggacuacaaccguaacgggcaagacuauucacgagugguguugccgcucuuguacccugcccccuuuacgguuuaaaggugaggacgggugcugguacggaauggaaaucagaccagugaaggagaaggaagagaaccucgucaaauccauggugucagcaggcaguggugaaguugauagcuucucgcugggccuucuguguauauccauuaugaucgaggaggugaugaggucucgcuggagccgaaagauguugaugacagggacccucgcggucuuucugcuacugacuaugggacagcucacauggaaugaccugauccggcuuugcauuauggugggcgccaacgcuucagacaugauggggaugggaaccacauauuuggcccugauggcaacuuuccguaugagacccauguuugcuguuggcuuacucuucaggcgccugaccagucgggaagugcuucugcuaacggucggucucucccugguagccucuguggaguugccuaacagccuggaagaguuaggggauggacucgcaaugggcaucaugaugcugaaacuucugacagacuuucaaccacaucaguugugggccacccuccugucccuaacuuucguuaagaccacauuuucacugcacuacgcuuggaaaacuauggcgaugauucuuagcauagugagucuccugcccuugugucugucuaccacgucccagaagacaaccugguuaccgguccuccugggcagccuugggugcaagccucugacuauguugcucaucacagaaaauaaaauuuggggaagaaggucguggccacugaacgaggguaucauggccauuggcaucgugucaauacuacugucuagucuucucaagaaugauguaccccuggcagggccuuugaucgcuggaggcauguuaauugccuguuaugugaucuccgguagcucugccgaccugagccucgagaaagcugcagaagucuccugggaggaugaagccgagcauucaggggcgagucacaacauucugguugaagugcaggacgauggaaccaugaagaucaaagacgaggagcgagaugacacucuuacaauacuguugaaggcuacccuacuggccauuagcggcguguaccccaugucuaucccagcaacacucuucgucugguauuuuuggcagaaaaagaagcagcgcuccggcgugcugugggauacuccuucacccccagaaguugagcgggccguacuugacaaugggaucuacagaauuuuacagaggggacugcucggucguagucaggugggcgucgggguguuccaagaaggaguuuuccauaccauguggcacgugacacgcggcgcugucuugauguaucaggguaaacggcuggagccgagcugggcauccgugaagagagaucucauaucuuacgggggaggcuggagguuucagggcucguggaacaccggggaggaaguacaggucaucgccguggagccuggcaaaaaucccaagaacguucaaacaacuccagguaccuucaaaacgcccgaaggcgaggugggggcgauugcucuggacuuuaagccuggaacaagcggcucaccaaucgucaaucgagaagguaagauuguggggcuuuacggaaacggcguugugacuaccuccggcacauaugucagugccaucgcacaggccaaggcuucucaggaggggccccugccugagauagaagacgagguguuccggaagcgcaauuugaccaucauggaucuacacccgggaagcgguaaaacuagaagguaccugccagccauuguacgggaagcaaucaagcgaaaacucagaaccuuagugcuggcucccacacgcguugucgccuccgagauggcggaagcccuuaagggcaugccuauuagguaucaaacgacugcagugaagucagagcauaccgggaaagagaucguggaccugaugugccacgcuacauuuaccaugcgucucuugucuccaguccggguacccaacuacaauaugauaauuauggaugaagcccauuucacugacccugcuagcaucgcagccagaggauauaucaguacaagggugggcaugggugaggccgcugcgauuuuuaugaccgcaacgccgcccggguccguugaagccuucccacagagcaacgcugugauccaggaugaggaacgcgacauaccugagcgaucuuggaacucaggauacgaguggauuacugauuuucccggcaagacagucugguucgugccauccaucaaaaguggcaacgacauugccaacugucugagaaagaaugggaaacggguugugcagcucagcaggaagaccuuugauaccgaauaucaaaagacuaaaaacaaugacugggauuacgucgugacaaccgacaucucggagaugggagcaaacuuccgcgccgaccguguaauagauccuagacggugccugaagcccgugauucuuaaagacgguccagaaaggguuauccuagcuggcccgaugccugucacaguggcgucugccgcacagcgccgagggagaaucggacggaaucccaacaaggagggcgaucaguacguguauaugggucagccacugaauaacgacgaggaucacgcucauuggacugaagccaaaauguuguuagacaauauuaacacgcccgaggggaucauuccugcacuguucgaaccagagagggaaaaguccgccgcuauagauggcgaguaccgccucagaggagaggccaggaagaccuuugucgaacugaugcggcguggcgaccuucccguuuggcugagcuauaaaguggcgucagagggguuccaauacagugaucgccgauggugcuuugacggagaaagaaauaaccagguacucgaggaaaauauggauguggagaucuggacaaaggagggugaaaggaaaaaguugcggccucgcuggcuggacgcaagaacuuauucugauccgcuagcccugagggaguucaaagaauuugcugccggccggcgauccgucagcggggaccucauucuugagaucggaaagcugccacagcacuuaacccagaaagcucaaaacgcauuggacaaucuggugaugcuccacaacucagaacagggcgguaaggccuacagacaugcuauggaggagcugcccgauacaaucgaaacccuuaugcugcucgccuugauugcaguucugacugggggcgugacguuauucuuucuaaguggacgcggccuggggaagaccagcauaggacuccuuugugucauggcguccucugcccuguuguggauggcuagcguagagccucacuggaucgccgcauccauuauccuggaguucuuucucauggugcugcuuauucccgagccagacaggcagcggacaccucaggauaaccaacucgcuuauguugugaucggucuguuguucaugauacugacugucgccgcaaaugagaugggcuuacuagaaaccaccaaaaaggaccuggggaucggacaugccgcugcggagaaccaccaccaugccgcaaugcucgauguggaccuucaccccgcuucagccuggacccuguacgccgucgcaacuacaauuaucacgccaaugaugcgucauaccauugaaaauacuacagcuaacaucucuuugaccgccauagcgaaucaggcugccauucugaugggccucgauaaagguuggccuaucaguaagauggacauuggggugccgcugcuugcauuaggcugcuacucgcagguuaacccccugacccucacagccgcuguguugaugcugguagcacacuaugccaucauaggaccaggccuacaagcgaaagcuacuagagaggcccagaagaggacggcagccgggaucaugaagaauccuaccguggauggaauugucgcuaucgaccuggaucccguuguguacgacgccaaauuugaaaagcagcucggccagauuaugcuucugaucuuguguacaagccaaauacugcucaugcgcacuaccugggcacugugcgaguccauuacauuagcuaccgguccacuuacuacgcugugggaggggucuccuggaaaauucuggaacacaaccaucgccgucucaauggcgaauaucuuucggggcagcuaucucgccggugcaggccuagcuuucucccugaugaagagucuagggggaggccgaagagggacuggagcccagggcgaaacccugggugagaaauggaagaggcagcucaaccagcuuucuaagagcgaguucaauauuuacaaacgcucagggaucauagagguggaucgguccgaagcaaaggagggacugaaaagaggcgagacaacuaagcaugcuguaagucgugguaccgccaaauugaggugguuuguggaacggaaccugguuaagcccgagggcaaggugauugaccucggguguggacgcggcggguggagcuauuacugcgccggacugaaaaaggucacagaagugaaaggcuauacgaagggugggccgggacacgaggaaccaaucccuauggcgaccuacggcuggaaucuagucaaacuucacucuggcaaggacguguucuuuacucccccagagaaaugugauacacugcuaugcgacauuggggaguccucacccaacccuaccaucgaagagggacgaacucucagaguucugaagaugguagaaccgugguugagggguaaucaauucuguauaaagauccugaaccccuacaugccaagcguggucgagacacucgagaaaaugcagcggaagcauggcgggaugcuugugcgcaauccucugucgagaaacucuacccacgaaauguauuggguuaguugcggaacgggcaacauuguguccgcugucaauaugaccagcaggauguuacugaaccgauuuacaauggcacaucggaaacccacuuacgagcgugauguggacuugggugccgggaccagacacguagcuguggaaccugagguugccaaucucgauaucauuggacagcgcaucgaaaacauuaagaaugagcacaaaucaacauggcauuaugacgaggauaacccauacaagacuugggcauaucacggcuccuacgaagucaagcccucuggcagcgccaguuccauggugaaugggguggucaggcugcuaaccaaaccuugggacguuaucccaauggugacacagauagcuaugaccgauacuacgcccuucggacaacagcggguauuuaaggagaaaguggacacaagaaccccgaaggcgaaacgcgguacugcccagauuauggaagucaccgcaagguggcuuuggggcuuccugagccgaaacaagaagccucggaucuguacaagagaggaauuuacgaggaaagugcgcucuaaugcugccaucggggcaguuuucguggaugagaaccaauggaacucagccaaggaggcugucgaagacgagcguuuuugggaccucgugcaucgggaaagagagcugcacaaacagggaaagugcgccacaugcguauauaacaugaugggcaaaagggaaaagaaguugggugaguucgggaaagcgaagggaagucgcgcaauuugguacauguggcugggcgcccgauuucucgaguucgaagcucuuggcuucaugaaugaggaucauugguuuucccgggaaaacagccugucugggguugagggagaggguuuacacaaacugggcuacauauugagagacaucucgaagauuccagggggaaauauguaugccgaugacacugcaggcugggauacaaggaucaccgaagacgaucuccagaacgaggcuaaaauuacugacaucauggaacccgagcacgcccugcuagcuacaucaauauucaaacuuaccuaccagaacaaagugguccgcgugcaaagaccugccaagaaugguacagugauggaugucaucagccggagggaccagcguggguccggacagguuggcacuuauggccugaacaccuuuacgaauauggaagcacagcucauucgacaaauggagagugaggggaucuucucuccaagcgaacuggagacccccaacuuggcggaacgcguguuugauugguuagagaagcauggaauugaaagacugaaacggauggccaucuccggugacgauuguguagugaagccgauagacgacagguucgcuacagcccucacugcacuuaaugauaugggcaaaguccgcaaggacauuccucagugggagcccucaaaaggguggaacgauuggcagcaagugccauuuugcagucaccauuuccaccaacugaucaugaaggacggaagagagaucguugugccuugucggaaucaggaugaguuagucggcagggcucgagugucucagggugccggguggagccugcgugagaccgcaugccucggaaaguccuacgcccagauguggcaauugauguauuuucacagacgcgaccugcggcuugcggcuaacgccauuuguucagcaguacccguugauugggugccaacaagcaggacuaccuggucuauacaugcccaccaucaguggaugacgacagaagacaugcuguccgucuggaauagaguguggaucgaggaaaaccccuggauggaggauaaaacccacguuaguagcugggaggacgugccuuaccucggcaagcgcgaagaucaguggugcggcucguuaauugggcugacugcucgggccacaugggcaaccaauauccaagucgcuauuaaccaggugaggcgauugaucggaaaugagaacuaucuggacuacaugacuuccaugaaaagauucaagaaugaaucugacccagagggugcccucugguga

SEQ ID NO: 13183 - RNA, 9879 nt, Artificial Sequence
  derived and/or modified CDS sequence (opt3) from DENV-1__AB195673__SS-prME
agcgugaccaugcugcucaugcuucugcccacggccuugacuuuccacuuaacgacccgaggcggggagccucauaugaucgucggaaagcaggaaagggguaaaucccugcuauuuaagacaucugcuggcguuaauaugugcacucucauugcaauggaccugggggagcuuugugaugacaccaugacauacaaaugcccacggauuaccgaaacugagccggaugacguggauuguuggugcaaugccacagaaaccuggguaacguauggaacuuguucacaaaccggcgagcaccgccgagacaagcguaguguggcgcuggcuccccaugucgguuuggggcucgagacaaggacugaaaccuggaugagcuccgagggagccuggaggcagauccagaaaguggaaacaugggcacugcggcacccuggcuucaccguuauugcccuguuucucgcucaugugaucggcacgucuauuacucagaaggggaucauauucaucuuacugaugcuugucacaccaucgauggcaaugcgcugcgugggaauugguaacagagauuuuguagagggcuugucaggggccaccuggguugacgugguccuggagcacggaagcugugugacuacaauggcuaaggauaaacccacccuagacaucgaacuccugaagacggaggugaccaauccugccguccuuaggaaacugugcauugaagcgaagaucaguaacacaacuaccgauucccgguguccaacacaaggcgaggcaacuuugguugaagaacaggacaccaauuucgugugccgccgaacauuuguagaucgggguugggggaacggauguggccucuucggcaaagggucucugauaaccugcgccaaguuuaagugcgugacuaaauuagagggaaagauuguccaguacgaaaaucugaaauauagcgugaucguuacggugcacacaggugaccagcaucaagucggcaacgagaccacugaacacgggaccauugcuacaaucacaccccaggccccuacuuccgagauccagcucacagacuacggagcacuuacgcuggauuguucaccaaggaccggcuuggacuucaaugaaauggugcuacugacuaugaaggagaaaaguuggcucguacauaagcagugguuucuggaucuuccgcugcccuggacaagcggugcuucuaccucccaagagacauggaaccggcaggacuugcucguuacuuucaaaaccgcccacgcgaagaagcaggaaguggucgugcuggggucacaagagggcgccaugcacacggcauuaaccggagcuacagaaauucagacuagcggcaccacaacuauauuugccgggcaucugaaaugccgucuaaagauggauaaacucacccugaagggaaucaguuaugucauguguacggguucuuucaaacuugagaaggaaguggcugagacacagcacggcaccguuuuggugcagguaaaguacgaggggacugacgccccuugcaaaauuccauucuccagccaagaugaaaagggagucacacagaauggccgccuggugaccgcaaaccccaucguuacugacaaagagaagccugugaauauagaagccgagccacccuuuggugagucguauauugucgugggggcuggcgaaaaagcgcucaagcugucuugguucaagaaaggauccucaaucggcaagauguuugaggcaaccgccagaggggcuaggcggauggccauccuuggagauacagcaugggacuucgguaguauuggcgggguauuuacgagcgugggaaaacugguucaucagaucuucggcaccgccuacggugucuuguuuuccggggugucuuggacuaugaagauuggcauaggaauccuccugacaugguuaggccugaacagccgaucaaccagucuauccaugacauguauugcuguggggcucaucacucuguaccuuggagucaugguucaggccgauagcggcugcgugaucaauuggaaaggucgcgaauugaagugugggucuggaauuuucgugaccaacgagguacacacguggacagaacaauauaaguuucaggcagacucaccgaaaagacugagugcggcuauaggcaaggccugggaggagggugucugcggcaucaggagcgcaacccggcucgaaaacauuauguggaaacagaucuccaaugagcugaaccauauuuuacuggaaaaugacaugaaguucacugugguugugggggaugucucuggaauccuugcccagggcaaaaagucgauacgcccucaacccauggagcacaaauacagcuggaaguccugggggaaggcuaaaaucauuggagccgacgugcagaacaccacauuuaucauugauggcccaaauacuccugaaugucccgacgaucagagagcauggaacaucugggagguugaggacuaugguuucgggauauuuaccacaaauauuugguugaagcucagggauucauacacacaggugugcgaccaccgucugaugagugcugccaucaaagauucuaaggcgguacaugccgacaugggauauuggauugaaagcgagaaaaacgaaaccuggaagcuagcucgggcauccuucaucgaggucaagacuuguauauggccaaaaucacacacacuguggagcaauggcgugcucgaaucugagaugaucauucccaagaucuacgguggcccuauuucccaacauaacuaucgaccaggguacuucacccagacugccggaccguggcaccugggcaaacuugaguuggauuuugaccugugcgaagggacaaccguggucguugaugagcacugcggaaauagaggccccaguuuaaggacgacuaccgugacagguaagaucauacaugaaugguguugccgcagcuguacccucccuccacugcgguucaaaggggaggacggaugcugguacggcauggagauuagacccguaaaggaaaaggaggaaaaccuugugaaaucuauggucuccgcugguucaggcgagguggacaguuuuagccugggguugcucuguaucucgaucaugauugaagagguuaugaggucccgcuggucucgaaagaugcugaugacuggaacacuagccguguuccugcuccugaccaugggccagcuuacauggaaugauuugauccggcugugcauuauggucggggcaaacgcgagcgacaauaugggaaugggcacuaccuauuuagcccucauggcuacguuucguaugagaccuauguucgccgugggucugcuuuuuaggcgccugacaucacgggagguucuacuccugaccgugggguugagucuggucgcauccguagaauuaccaaacucucucgaggaacugggagauggccuugcuaugggcauaaugauccugaaauugcucacugacuuccaaagccaccagcugugggccacccuacugucccuuacauuugugaagacuaccuucucacuccauuacgcauggaaaacgauggccaugauucugagcaucguuaguuuguuuccccuguguuuaucuacaaccucccagaagacuacauggcucccggugcugcuugggagccugggaugcaagccuuugaccauguuccucauuacugagaacaaaaucugggguagaaagucguggccacugaaugaaggcauaauggcugucgggaucgugucaauucuacugucuagucuucucaaaaacgauguaccccuggcgggaccuuugaucgccggcgguauguuaauugcauguuaugugaucuccgggagcucugcugaccugagccucgagaaggccgccgaggucuccugggaagaggaagcugagcacucaggagcaagucauaauauacugguugaaauucaggaugacggcacaaugaaaaucaaggaugaggagagggacgauaccaucacgauucuucugaaagccacuuugcuagcgauaagcggcguguaccccaugucuaucccagcuacccuguuugugugguauuucuggcaaaagaagaaacagcgauccgggguccucugggacacaccuucacccccagaaguggagcgcgccguucuggaugacggaauuuaccggauccuucagagagguuuacugggcaggagucagguaggggugggagucuuccaagaaggcguguuucacaccauguggcacguuacacguggugcagugcucauguaucaggggaagcgcuuggagccgagcugggccuccgucaaaaaggaccugauuucuuacggaggcggcuggcgguuccaggggucguggaacacuggagaggaagugcagguaaucgcugucgagccugguaaaaaucccaagaacgugcaaaccgcaccaggcacguuuaagacaagcgaaggggagguuggagccauagcgcucgauuucaaacccggcacuucagguuccccuaucgugaauagagaagggaagauugucggacuguacggcaacggcgugguuaccacaagugggaccuaugugucugcuaucgcccaggcaaaagccagccaggagggaccacuucccgagauugaagacgaggucuuuaggaagcgaaaucugacuaucauggauuugcauccugguuccggcaaaacccggcgcuaccuaccggcuauagugagagaagccauuaagaggaagcugcggacacucguauuagcaccaacgcgagugguugcuucagagauggccgaagcgcugaaagggaugcccaucagauaucaaacuaccgccgucaagucugagcacacaggacgcgagaucguggaccuuaugugccaugcaaccuucacuaugaggcugcucagcccugugcgugucccaaacuacaauaugauuaucauggaugaagcucacuuuacagaccccgccaguauagcugcacggggcuauauuuccaccagaguagguaugggggaggccgccgcuaucuucaugacggcgacuccuccgggaagcguggaagcauuuccccagucuaacgccguuauucaggaugaggaaaaagacaucccagagaggucauggaacuccggcuacgauuggauaacagacuucccuggcaagaccgugugguuuguccccaguauuaaaagcgggaacgauaucgcuaauuguuugcgcaagaacggaaagcgagugauccagcugucgagaaaaaccuucgacacugaguaucaaaagaccaagaauaaugacugggauuacguugugaccacagacauuucugaaaugggugccaacuuccgggcagauagggucaucgacccacgccguugccucaagccugugauucugaaagauggccccgagagaguaauacuugccgggccaaugccggugacuguugcuuccgcggcccagcggaggggacgcaucggccgaaaucagaacaaggaaggugaccaguacauuuauauggggcaaccucuaaauaacgaugaggaccaugcacacuggacggaggcuaagaugcuguuggauaauaucaacacccccgaaggcaucauuccagccuuauuugagcccgaaagagagaaaagcgcagccauagacggagaauaccggcugaggggcgaggcucgcaagacauucgucgagcucaugagaagaggggaucugccuguguggcuuucauauaaaguggccagugaaggauuucaguacucugaccggcguuggugcuucgauggugagcgcaauaaccagguccuggaagagaauauggacguugaaaucuggacuaaggagggcgagaggaaaaagcucagaccaagaugguuggacgcgcggaccuauuccgauccccuggcacuacgcgaauuuaaagaguucgccgcugggagaaggagcgugucaggagaccugauucucgaaaucggcaaacuuccucagcaccugacacaacgggcccagaacgcuuuagauaauuugguaaugcugcauaacagugagcagggugggaaggcauaccgacacgccauggaggaacucccggacaccauugagacucugaugcuucuggcucucaucgccguguugacgggcggagucacccuguuuuucuuaagcggcagagggcuaggaaaaacauccauaggucugcucugugugaugucuagcuccgcacuucuguggauggcgucaguugaaccacauuggaucgccgcuucuauuaucuuggaguuuuuccugauggugcuccugauucccgaaccugaucgccagaggacuccccaagacaaucagcuugccuaugucguaaucggccuccuguuuaugauauugaccguggcagcuaacgagauggggcuguuagagacaaccaagaaagaucuaggaauuggccacgccgcagccgaaaaccaccaucacgcugcgaugcuggacguugaucuccauccagccagugcauggacucuuuacgcuguggccacaacgaucauuaccccuaugaugcggcacacuaucgagaauacaaccgccaacauaucgcugaccgcaaucgcuaaucaggccgcgauuuugaugggucuggacaagggguggcccaucagcaaaauggauauuggcgucccacuccuggcucuuggaugcuacucccaagugaacccuuuaacacugacugccgcaguccucauguugguggcccauuaugcuaucauaggcccggggcugcaggcaaaggccacgcgugaagcgcagaagagaaccgcugccggaauuaugaaaaaucccacaguugacggcaucguggcaaucgaucuagacccaguaguguacgacgccaaguucgagaaacagcugggucaaauuaugcuccuuauccuguguacuucucagauauugcugaugaggaccacaugggcucucugcgaaucaauuacccuggccacugggccuuuaacgacacuuugggagggaagccccggcaaguuuuggaacaccacuaucgcagucuccauggcuaauauuuuccgcgguaguuaucuggccggcgcggggcucgccuucucucuaaugaaaagccugggaggcgggcggcgaggaaccggcgcacagggugagacauugggggaaaaguggaagagacagcugaaccaacucucaaaauccgaguuuaauaucuacaagaggaguggaauaguugaaguggaucgcagcgaggcuaaagaaggccuuaagcggggugagacuaucaaacacgccgucucuagaggcaccgcaaagcugcguugguucguggagaggaacuugguaaagccagaagggaaagugauugaccugggauguggcagaggcgggugguccuauuacugcgcugggcucaagaaaguuacagaggugaaggguuauacgaaagggggaccuggccacgaggaacccaucccgauggccaccuacggcuggaauuuagucaagcuguacucagggaaagauguguuuuucauuccaccugaaaagugugacacucuucugugcgauaucggagagagcucgcccaacccaacaauugaggaaggucgcacccuacgaguccucaagaugguggagcccuggcugagaggcaaucaguuuuguaucaaaauauugaacccuuauaugccgucuguuguagaaacucuggagcagaugcagaggaagcaugggggaaugcucgugcggaauccccuuagucgcaacuccacacacgagauguacugggucagcugcggcaccgguaauauugugucagccguuaacaugacguccagaaugcuguuaaacagguucaccauggcgcaucgaaaaccaacauaugaacgggacguggaucugggggcuggaacucgucacgucgcaguggagccugaaguagccaauuuggacaucaucggccaaagaauugagaacauaaagaaugaacacaaaucuaccuggcauuacgaugaggacaaccccuauaagacaugggcuuaccacggcagcuaugaggugaagccuaguggguccgccagcucuaugguuaauggagucgugcgccuccugacuaaaccaugggaugugauccccauggucacccagauugcaaugacagacaccacuccuuuuggucagcaaaggguuuucaaggaaaaaguggacacgcggacaccaaaggccaaaagaggcaccgcucagaucauggagguaacugcgaaguggcuauggggguuucuuucacgcaacaagaaacccaggauuuguacccgagaagaguucacacggaaggugagaaguaaugccgcaaucggagcugucuuuguggaugaaaaccaguggaacuccgccaaagaggcaguugaggacgaaagguucugggaucuggugcgccgugagcgggaacuccauaagcagggcaaaugcgccacgugcgucuacaacaugauggguaagagagagaagaaacugggggaauuuggaaaggcuaaaggcagcagggccauaugguacaugugguugggcgcgcgcuuccuggaguucgaggcacucggguuuaugaaugaagaccacugguucucucgagagaacucgcuuucaggaguggaaggugagggccugcauaaguuaggguauauccugcgggauauuagcaaaaucccgggaggcaauauguacgccgacgauaccgcugguugggacacuagaauuacagaggaugacuugcaaaacgaagccaagaucaccgauauaauggagccugaacacgcacuccuggcuacuuccauuuuuaaacuaacauaucagaauaagguaguuagggugcagcgcccagccaagaacgggaccgucauggacgugaucaguagacgggaucagaggggaucuggccaagugggcacauacgggcuuaacacuuucaccaauaugggagcucagcugauccgucagauggagagcgaagguauauuuucccccucagagcucgagacgccuaaccuggccggccgagucuuggacugguuagaaaaacacgggauagagcgccugagacggauggcaaucaguggagacgauuguguugugaagccaauugacgauagguucgcgaccgcccucacagcucuuaaugacaugggcaaaguacgcaaggauaucccccagugggaaccgucuaaagguuggaacgacuggcaacaggugccuuuuugcagccaucacuuccaucagcugauuaugaaggaugggagagagaucgucgugcccugucggaaucaggacgagcuaguuggaagggcccgagugucccaaggcgcaggcuggucacugcgugagacugcuugccucggaaagagcuaugcccagauguggcaguugauguacuuucacagacgcgaucugcggcuugcagccaacgcgauauguucugcugucccaguggacuggguaccuaccuccaggacaacuuggaguauccacgcccaucaccaauggaugaccacggaggauaugcugagcguuuggaauagaguguggauugaagagaaccccuggauggaagacaaaacacaugucucguccugggaggacgugccauaucucggaaagcgcgaagaucaguggugcgguucuuuaaucggccugaccgcacgggccacuugggcuacaaauauucagguugccaucaaccaggugaggcgauugauugggaaugagaacuaccuggacuacaugaccucaaugaaaagauucaagaaugagagcgaucccgaaggagcacucugguga

SEQ ID NO: 13184 - RNA, 9879 nt, Artificial Sequence
  derived and/or modified CDS sequence (opt3) from DENV-1__AB204803__SS-prME
agcgugaccaugcugcucaugcuucugcccacugucuugacuuuccacuuaacgaccagaggcggggaaccucauaugauaguuuccaagcaggaaagaggaaaaucucugcuauuuaagaccucagccggugugaacaugugcacucucauugcuauggaccugggcgaacuuugugaagauaccaugaccuacaaaugcccacggauaaccgaaacugaaccggacgauguagacuguuggugcaaugcaacagaaaccugggugacguaugggacuuguagucagaccggagagcaccgccgagauaagcguagcgucgcccuggcgccccaugugggcuugggucucgaaacacggacugagaccuggauguccucugaaggggcuuggaaacagauccagaagguugagacaugggcccugaggcacccuggauucaccgugauugcacuguuucucgcccaugcuaucggcacgucgauuacucagaagggcaucauauucaucuuacugaugcuugucacaccaucaauggcaaugcggugcguggggauuggaaaccgcgacuuuguagaggguuugagcggcgccaccuggguugaugugguccuggaacacgggaguugugugacuacaauggcuaaagacaagcccacccuagauaucgagcuccugaaaacggaagugaccaauccugccguccuuagaaagcugugcauugaggcgaaaaucuccaacacaacuaccgacucuagguguccaacacaaggagaagcaacuuugguugaggagcaggauaccaauuucgugugccggcgcacauuuguagaccgaggcugggguaacggguguggacucuucggcaagggcagccugauaaccugcgugaaguuuaaaugcgucacuaaguuagaagggaaaauugugcaguacgagaaucugaaguauuccguuaucgugacgguccacacaggagaucagcaucaaguggguaacgaaaccacugagcacggcaccauugccacaaucacaccccaggcuccuacuucagaaauccagcucacagacuacggggcccuuacgcuggacuguaguccaagaaccggauuggauuucaaugagaugguacuacugacuaugaaagaaaagagcuggcucguucauaaacagugguuucuggaccuuccgcugcccuggacaucuggcgcauccaccucacaagaaacauggaacaggcaggauuugcucgugacuuucaagaccgcucacgccaagaaacaggaggucgugguccuggguagccaagaaggggcgaugcacacggccuuaaccggcgcaacagagauucagacaaguggaaccacaacuauauuugcuggccaucugaagugccggcuaaaaauggacaagcucacccugaaagggacgucuuaugugauguguacaggaccuuucaaacuugaaaaggagguugccgagacccagcacgguacuguguugguacaggucaaauacgaaggcacagaugcuccaugcaagauccccuucuccagccaagacgagaaaggggugacccagaauggacgucugauuacugccaacccuaucguuaccgauaaggaaaaaccaauaaauauugaggcagagcccccguuuggcgaaucguauaucguggucggugugggggagaaggcccucaagcugucuugguucaaaaagggcuccucaaucggaaaaauguuugaagcuacagcgcgcggcgcaagaaggauggccauucuuggggacacggcuugggauuucggaaguaucgguggcguauuuaccagcauggggaagcuggugcaucagauuuucggaacugccuacggcguuuuguuuuccggugucucuuggacaaugaaaauagggaucggcauucuccugaccugguuaggacugaacagccggucaacaagucuauccaugacuuguaucgcagugggcauggugacccucuaccugggggucaugguucaggccgacagcggaugcgugaucaauuggaagggccgagagcuuaagugugguucugggauuuucgugacgaacgaaguacacacauggaccgagcaauauaaauuucaggcugauucaccuaagcgcuugagugccgcaauaggaaaagcgugggaggaaggcgucugcgguaucagaagcgcuacuaggcuggagaacauuauguggaagcagaucuccaaugaacucaaccauauucuguuagagaaugacaugaaauucaccgugguugugggcgacgucucugggauccuggcccagggaaagaaaaugauacggccccaaccaauggaacacaaguacucguggaaaagcuggggcaaagcaaagaucauuggggccgaugugcagaacacaacuuuuaucauugacggaccuaauacccccgaguguuccgaugaccagcgcgcuuggaacaucugggagguugaagauuauggcuucgguauauuuacaacgaauauuuggcuuaaauugagagacucauacacccaggugugcgaucacaggcucaugagugccgcaaucaaggacucucgugcuguacaugccgauaugggguauuggauugagagcgagaagaaugagacuuggaagcuggcgcgggccuccuucaucgaagucaagacauguauauggccaaaaucacacacccuauggagcaauggagugcuggagucugagaugaucauucccaagaucuacggcgguccuauuucccaacauaacuaucgaccaggcuacuucacucagacagcugggccguggcaccucggaaaacuggaacuugacuuugauuugugcgagggcaccacgguggucguugacgaacagugcgggaauagaggacccagucugaggacuaccacagugaccggcaagaucauacacgagugguguugccgcagcuguacuuuaccuccacuccgguucaaaggugaggaugggugcugguacggaauggaaauuagacccguaaaggagaaggaagagaaccuggugaaaucuauggucuccgcaggcucaggugaaguggacaguuuuagccuuggccuguuguguaucucgaucaugauugaggagguuaugaggucccgcuggucucgaaagaugcucaugacagggacccuggccguguuccuacugcucacaaugggacaacugacuuggaaugaccuuauccgguugugcauuauggucggcgcuaacgccagcgauaaaauggggaugggaaccacguaucuggcauuaauggcgacauuucguaugagaccuauguucgccgugggccuccuguuuaggggucuuaccucacgcgaaguucugcuacucacuguggggcugaguuuggucgcuuccguagagcugccaaauucuuuagaggagcucggagacggccuggccaugggcauaaugaugcuuaagcuguugaccgauuuccagagccaucagcucugggcaacacugcuaucccugacuuuugugaaaaccacguucucacuucacuacgcuuggaagacaauggccaugacccucagcaucguuagucuguuucccuugugucugucuacuacaucccagaagaccacuugguuaccggugcuccuggggagccuuggaugcaaaccucugacaauguucuugauuaccgaaaacaagaucuggggucggaaaucguggccacucaacgagggcauuauggcagucgggaucgugucaauacugcuaucuagucugcuuaagaaugacguaccccucgccggaccucugaucgcuggcgguauguugauugcguguuaugugaucuccgggagcucugccgauuuaagccuggagaaagcagcugaagucuccugggaggaagaggccgaacauucaggagccagucacaacauucucguugaggugcaagacgauggcacgaugaagaucaaagacgaggaaagagaugacacuauaaccauucugcuuaaggcuacacuguuggcaaucagcggcguguaccccaugucuaucccagccacccuauuugucugguauuucuggcagaagaaaaagcagagguccggggugcugugggauacaccuucacccccagagguugaacgagcgguacucgacgauggaauuuaccgcauacugcagcggggucuuuuaggcagaagucaagugggggucggaguguuccaggagggcguuuuucauacuauguggcacgugaccaggggugcuguccugauguaucaggggaaacgucucgagccgagcugggccuccgugaagaaagacuugaucucuuacggaggcggcuggcgcuuccaggggucguggaauacgggagaagagguacaagucauugcaguggaaccugguaagaaccccaagaauguucagacagccccaggcacuuuuaaaaccagcgagggggaagugggagcuaucgcacuggacuucaagcccggcacaucagguuccccuauugucaaccgggaggggaaaaucgugggacucuacggcaauggcguugugaccacaagugggaccuaugucucugccauagcgcaggcuaaggccagccaagagggaccacugcccgaaaucgaggaugaaguguuuagaaaaaggaaccuuacaauuauggaccugcacccugguuccggcaagacgcgacgguacuugccggcaaucguacgcgaggccauuaagagaaaacuaaggacucuggugcucgcuccaacccggguugucgccucagaaauggcagaggcuuuaaaggggaugcccauccgauaucagacaaccgccgugaaaucugagcauacuggaaaggaaauaguggaucugaugugccacgcgacauucaccaugagacuucugagcccuguccgcguaccaaauuacaacaugauuaucauggacgaggcccauuuuacggaucccgcaaguaucgcugccaggggcuauauuuccacucguguggguaugggggaagcugcagccaucuucaugacagccaccccuccgggaagcguugaggcuuuuccccagucuaaugcggugauacaggacgaagagaaagauauuccagagcggucauggaacuccggcuacgacuggaucaccgauuucccuggcaagacugucugguuugugcccaguauuaagagcgggaaugacaucgcaaacugucucaggaagaauggaaagaggguuauacaauugucgcgcaaaacauucgauaccgaauaucagaagacuaagaacaacgacugggacuacguggucacuacggauauuucugagaugggugccaauuuccgagcugacagagugaucgauccacggaggugccugaagccuguaauccucaaggacggccccgaacgcgugauucuggccgggccaaugccgguuaccgucgcauccgccgcucagcguagaggacggaucggcaggaaccagaauaaagagggugaucaauacauuuauauggggcagccucuuaacaaugacgaggaucacgcgcauuggacagaagccaagaugcuacuggacaacauaaauacucccgagggcaucauuccagcauuguuugaacccgagcgcgaaaagagcgcugccaucgauggagaguaccgauuaagaggcgaggcacggaagaccuucguggaacugaugaggcgcggggaccucccuguguggcugucauauaaagucgccagugagggauuucaguacucugauagaagguggugcuucgacggugaacggaacaaucagguucuugaggaaaacauggauguggagaucuggacaaaggagggcgaacguaaaaagcugcgcccacgauggcucgacgcuagaaccuauuccgaccccuuggcccugagggaguuuaaggaguucgcggcagggcggcgcagcguaucaggagaucuaauucuggagauaggcaaacucccucaacaccuuacucagaaggcccagacggcucuggacaauuuagugauguugcacaacagugaacagggugggaaagccuacagacaugcuauggaggagcugccggauaccaucgaaacacucaugcugcuugcacugauugccguccucacuggcggagugaccuuguuuuuccugagcggcaagggguuaggaaaaacauccaucggucuacuguguguuaugucuagcuccgcucuccuuuggauggccucaguggagccacacuggauugcagcgucuaucauacuggaauuuuucuugaugguccugcucauccccgagccugacaggcaacggacaccccaggauaaucagcuggccuauguagugauuggccuucucuuuaugauccugacuguugcugccaacgagaugggguugcuggaaacaacgaagaaggacuuaggaauuggccaugcagcugccgagaaucaccaccaugcagccaugcuagauguggaccugcacccagcuagugcguggacccucuacgccgucgcaacuacaaucauaaccccuaugaugcgacauaccauugaaaacacaacugcuaacaucucgcuuacggccauugccaaucaagcagcuauccugauggguuuggauaaaggguggcccauaagcaagauggacaucggcgugccacugcucgcccugggaugcuacucccaggucaacccucuuaccuuaacagcggcugugcugaugcucguugcccacuaugcaauuaucggcccgggguugcaggccaaagcuacuagagaggcacagaagcgcaccgccgcgggaauuaugaaaaaucccacaguggauggcaucguagcuauagaccuggauccaguggucuacgacgccaaguucgaaaagcaacuaggucagauuaugcugcucauccuuuguaccucucagauccuguugaugaggacuacgugggcacugugcgagucaauuacacucgccaccgggccucugacuaccuuaugggagggaagccccggcaaauuuuggaacacaacuaucgcuguuuccauggccaauauauuccgggguaguuaucuugcaggcgcugggcuggccuucucucucaugaaaagccuaggaggcgggcguagaggaaccggcgcgcagggugaaacacugggggagaaauggaagaggcaauugaaccagcugucaaaauccgaauuuaauacguacaagcgcaguggaauuauggagguggaccggagcgaagccaaggagggccucaaacgaggugagaccacuaagcaugcagucucuagaggcacagcuaaacuuaggugguucguggaacgcaaccugguaaagccagaggggaaagugaucgauuugggauguggcagagggggaugguccuauuacugcgccggccugaagaaaguuaccgaagugaaggguuauacuaaagggggaccuggccacgaggaacccauuccgauggcaacauacggcuggaaucucgucaaauuacacucagggaaggacguguuuuucaucccaccugagaaaugugauacccugcuuugcgacauaggagagagcucgcccaacccaacgaucgaagaggguagaacccugcguguccuaaagaugguggaacccuggcucaggggcaaucaguuuuguauuaaaauccugaacccuuacaugccgucuguuguagagacauuggagcagaugcaacggaagcaugggggaaugcuggugcgcaauccccucagucgaaacuccacucacgaaauguauugggucagcugcggcaccgguaauauugugucagcuguuaacaugacauccagaaugcuucugaauagguucacuauggcccaucggaagccaaccuacgagcgcgauguggacuuaggggccggaacaagacacgucgcgguggaaccugagguagcuaaccuggauaucauuggccagaggaucgaaaacaucaaaaaugagcacaagucuaccuggcauuaugacgaggauaaccccuacaaaacuugggcauaucacggcagcuacgaagugcgaccuaguggguccgccagcucuaugguuaauggagucgugcgguugcucacgaagccaugggacgugauucccauggucacacagaucgcuaugaccgauacuaccccuuuuggucaacagcguguuuucaaagagaagguggacacaagaacgccaaaggccaaacgcggcaccgcacagaucauggaaguaacugccaaguggcuguggggguuucuaucaaggaacaaaaagccccggauuuguacaagagaggaguucacccgcaaagugaggaguaaugcugcgauaggagccgucuuuguggacgagaaccaguggaacuccgcaaaggaggcuguugaagaugagcgauucugggaccuugugcaucgggaaagagagcugcacaagcaaggcaaaugcgccacuugcgucuauaacaugauggguaagagggagaaaaagcucggggaguuuggaaaagcaaagggcagccgcgccaucugguacauguggcugggcgcucguuucuuggaguucgaagcccugggguuuaugaaugaggaucauugguucucucgggaaaacucgcucucaggaguggagggugagggccuucacaaacugggguacauuuuaagagacaucagcaagauuccgggaggcaauauguaugcggaugacacagcagguugggauaccaggaucacagaagacgaucugcagaacgaggccaagauaacugacaucauggaaccugagcacgcuuugcucgccaccuccauuuuuaaacugacguaccagaauaagguaguucgcgugcagcgaccagcaaaaagugggaccgucauggaugugaucucucggagagaccaaaggggaagcggccaggugggcacauaugggcuaaacacuuucaccaauauggaagcucagcuuauucgccagauggaguccgagggaaucuuuucacccagugaacuggagacaccuaaccucgccgguagaguccuggauugguuggaaaagcauggcauagagcgguuaaaaaggauggcuauuucuggggacgacuguguugugaagccaaucgaugaccguuucgccacugcacugaccgcgcucaacgauaugggaaagguacgaaaagacaucccccaaugggaaccgagcaagggcuggaaugauuggcaacaggugccuuuuugcucccaccauuuccaccagcuuauuaugaaagacggucgcgagauagucgugcccuguagaucacaagaugagcugguugggcgggccagggugagccagggagcuggcuggucucuacgcgaaacggccugccugggcaaguccuacgcacagauguggcaacucauguauuuucacagacgggacuugaggcuggcugccaacgcaaucuguagugccgucccaguggauuggguaccuacaagccgaaccacuuggucgauucaugcgcaccaucaguggaugacaaccgaggacaugcuuuccguuuggaaucguguguggaucgaagagaaccccuggauggaagauaaaacucacgucucuucaugggaggacgugccauaccuggggaagagagaggaccaguggugcggaagccucauugguuuaaccgcucgcgccacaugggcaacgaauauccagguugccauaaaccaagugcggaggcugaucggcaaugaaaacuauuuggauuacaugaccaguaugaagagauucaaaaaugaguccgaccccgaaggggcucugugguga

SEQ ID NO: 13185 - RNA, 9879 nt, Artificial Sequence
  derived and/or modified CDS sequence (opt3) from DENV-1__LC016760__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaauaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaagaagaugauccgcccucaacccauggagcacaaauacucguggaaaagcuggggcaaggcgaagauaaucggggccgacgugcagaauacuaccuuuauuaucgauggaccaaacacaccugaaugucccgacgaucagagagcuuggaauauuugggaggucgaggacuauggcuucgguaucuuuacuaccaacauauggcuuaaguugagggauuccuacacacaggugugcgaccaccgucucaugucagcagccauuaaagauaguaaggcuguucaugccgacaugggguauuggaucgaaucugagaaaaaugaaacguggaagcuggcacgggcgagcuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgccgggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguacagaggugaggacgggugcugguauggaauggagauaaggcccguuaaagaaaaggaggaaaaucuggugaaguccaugguaucugcuggcuccggugagguggacucauucagucuuggccuguuguguauuagcaucaugaucgaagaggucaugcgcucgcgauggucccggaaaaugcucaugaccgggacucuggccguguuuuuccuacugauuaugggacagcucacauggaacgaucugauccgucuuugcauuaugguuggcgcaaaugcuucugacagaauggggaugggaaccacauacuuggcccugauggcaacuuuuaagaugaggccuauguucgccgugggcuuacucuuucgccggcugaccagcagagagguccuucugcuaacgauaggucucucacugguggcuaguguugaauugccaaacucccuggaggaauuaggggauggacucgcgaugggcaucaugauucugaaacuucugacagacuuccaaucucaccaguugugggccacccuccugagccuaacuuuuaucaagaccacauucucccugcauuaugcauggaaaacuauugcuauggugcuuucaaucgucagccucuuuccccuguguuugaguaccacgucucagaagacaaccuggcugccgguauuacucggcucccuggggugcaagccucuuacuauguuccugauagccgagaauaaaaucuggggaagaaagagcuggccauugaacgaagguauuauggccgugggcaucguuucgauucuccugucaucucuacugaaaaacgaugugccccuugcugggccucucaucgcaggaggcaugcugauagccuguuacgucauuagugguuccagcgcggacuugucuuuagagaaggcugccgaggugagcugggaagaggaagcagagcacuccggggccucacauaauauccugguagaagugcaggaugacggaacaaugaaaaucaaggaugaggagcgagacgauacccucacuauucugcuuaaagcuacacuguuggcagucaguggcguuuauccccuaagcauaccagccacccuguuugugugguacuucuggcaaaagaagaaacagcgcucuggcgugcucugggacacgccuucacccccagaagucgagcgggcggugcuggaugacgggaucuauagaauuaugcagaggggacuuuuaggucguagccagguuggcguagggguguuccaagaaaacgucuuucacacuauguggcacgugacccgcggagcuguucugauguaccagggcaagcggcucgagccgaguugggccagcgugaaaaaggacuugaucuccuacggugggggauggagacugcagggcucuuggaauacaggcgaggaaguccaggugauugcaguagagccugggaaaaaccccaagaauguccaaaccgccccaggaacauucaagacucccgaaggugaggugggcgcuaucgcccucgauuuuaaaccugggaccucgggaagcccaauaguuaacagggaaggcaagaucgugggucuguaugggaauggagucgugacgacaucaggcacuuacguuuccgcaauugcucaggccaaagcgagucaggagggcccccuuccugagaucgaagacgagguguuccgaaagcggaaccugaccauuauggauuugcauccggggucuggaaaaacacgcagauaucuaccagccaucgucagggaagcaauaaagcggaagcugcgaacccucauuuuagcucccacuagagugguagccagcgagauggcugaagcacugaaagguaugccuauccgcuaccaaaccacagccgugaaguccgagcacacgggcaaagagaucguugaccuuaugugccaugccacuuuuaccaugaggcugcucucaccaguccgugugcccaauuauaacaugauuaucauggaugaagcucacuucacagacccuucuagcauagcggcacggggguacauuaguaccagagugggaaugggcgaggccgcugccaucuuuaugacugcaacaccgcccgguuccgucgaagccuucccacagagcaaugcuguaauucaggaugaggaaagggacaucccugagcgcucuuggaacucaggguaugaguggauaaccgauuuucccggaaagacggugugguucguuccauccauuaaaaguggcaaugacaucgcgaacuguuugcgaaagaauggcaagagagugauccagcugagccggaaaacuuuugauacagaauaccaaaagaccaaaaacaacgacugggacuacgucgugaccacugauauuucggagaugggggccaauuucagggcagaccgcguuaucgauccucguagaugccucaagcccgugauucugaaagacggaccagaacgggucauacuugcugguccgaugccugugacaguagccucugcagcccagaggcgcggccgaaucgggagaaaccauaauaaggagggagaucaguauauuuacaugggccagccccuaaacaaugacgaggaucacgcucacuggaccgaagccaagaugcuguuggacaacaucaauacaccagaggguaucauucccgcguuauucgaaccugagcgggaaaaauccgcagccauagauggggaguauaggcugcgcggcgaggcuagaaagacuuuuguggaacucaugaggcggggagaccugccaguuuggcuuagcuacaaagucgccucagagggcuuccaauauagugaucgucgcuggugcuuugacggggaacgaaacaaucaggugcuggaggaaaacauggauguggagaucuggacgaaggagggagaaaggaaaaagcucaggccccggugguuggacgcucgcaccuacucugacccucuggcacuaagagaguucaaagaauuugccgcugguaggcgguccgucagcggcgaucugauucucgagaucgggaaacuuccgcagcaucugacacagcgagcccaaaaugcauuagacaacuugguuaugcugcacaauucagaacagggaggcagagcguaucgccaugccauggaggagcucccagauacuauugaaacccugaugcuucuggcucucaucgccguguugacaggugggguaacccuguucuuuuuaaguggcaagggacuaggcaaaacuagcauagggcugcucugugugauggcauccucuguccuucuguggauggcuagcguggagccccacuggaucgccgcauccauuaucuuggaguucuuucugaugguucuccugauuccugagcccgacaggcagcggacgccacaggauaaccaacuugccuacguggucaucggacuccuguucaugauauugaccguagcugcgaaugagaugggucuguuagaaacaacuaagaaagaccuaggcauugggcacguggccguugagaaccaucaccaugcagcuaugcuggauguggaccuccacccugccucagccuggacccuuuacgcagucgcuacaaccaucauuacucccaugaugcgucauacaaucgaaaacacgaccgccaauauaucucugacugcgaucgcuaaccaggccgcaauuuugaugggacuggauaagggcuggccaaucaguaaaauggacauuggugugccucuccuggcccuugggugcuauucgcaggucaauccguuaacacugaccgcugcagugcucauguugguugcccacuacgcgaucauaggccccggacugcaagcuaaggccaccagagaggcacagaagaggacagccgcuggcauuaugaaaaacccaacuguggaugggaucguagccaucgaccuagauccuguggucuaugacgcaaaguuugaaaaacagcugggacagauuaugcuccuuauccuguguacgagccaaauauugcugaugcgcaccacaugggcucucugcgaguccauuacucuggccaccggccccuuaacaacccuuugggaggguucuccagggaaguucuggaauacuacgaucgcgguuucaauggccaacauuuuucggggaagcuaccuggcaggcgcuggucucgccuucucccuaaugaaaagucugggcgggggacgaagaggcacaggggcacagggagaaaccuugggcgagaaguggaagaggcagcugaaucagcucucuaaaagcgaguucaacacuuauaagcgcucagguaucauggagguggaccgguccgaagcuaaagaggggcuuaagagaggagagaccacaaaacacgccgucagucguggcacugccaagcugaggugguuuguggaacggaauuugguaaagccugaggguaaagugauagaucugggcugugggcgcggaggcuggagcuacuauugcgcggggcucaagaaaguuaccgaagugaagggauacacaaaaggcggucccgggcaugaggaaccggucccaauggcuacguacggauggaacuuagugaagcugcacucuggcaaagacgucuucuuuaucccucccgagaagugugauacccuucugugcgacauuggcgaguccucaccaaaucccacuaucgaagaggggcgaacacuaagagugcucaagaugguugaaccuuggcugaggggaaaccaauucuguauuaaaaucuugaauccguauaugcccagcguaguggagacccuggagcagaugcagcggaagcaugguggcaugcucguccgcaacccacuuucgagaaauucuacucacgaaauguacugggugaguugcgggacaggaaacauuguuuccgcaaucaauaugaccagcaggaugcuguuaaaccgauuuacgauggcccaccggaaaccuaccuaugagcgugauguggaccugggcgcugguacaagacaugucgccguggaacccgagguagcaaacuuggauauaauugggcagcgcaucgaaaauaucaagugugagcacaaaucaacuuggcauuacgacgaggauaacccuuauaagaccugggccuaccacggauccuaugaagugaagccaucuggcagcgcuaguuccaugguuaauggcgucgugaaacuccugacaaagcccugggacgugauuccuauggucacucaaauagcgaugaccgauacaaccccauucgggcagcagaggguuuuuaaagagaagguggacacucggacgcccaaagccaagagaggaacagcacaaaucauggaaguaaccgcucgcuggcuaugggguuuccuuagcaggaacaagaaaccgcgaauuugcacucgggaggaauuuaccagaaaggugaggucuaaugccgcaaucggcgccgucuucguggacgagaaccaguggaacucagcuaaagaggccguugaagaugagcgcuuuugggaccuggugcaucgugaacgggagcuccacaagcaggggaaaugcgcgacaugugucuacaacaugaugggaaagagagaaaagaaacugggcgaguucgguaaggcaaaagggaguagggccauuugguacaugugguugggagcucgcuuucuggaguucgaagcccucggcuucaugaaugaggaucacugguuuucccgagaaaacagccuuucuggcguggagggggagggacugcauaaguuagguuauauccugcgggacauaucgaaaaucucaggcgggaauauguacgcagaugacacggcuggaugggauaccagaauuacugaagacgauuugcagaacgaggccaagaucacagaaauuauggagccugaacacgcucaacucgccaaagcaaucuucaagcugaccuaucagaauaagguaguuagggugcagcgcccagcgaaaaacggcacugucauggacgugauaagcagacgggaucagagggguuccgggcaagugggaacauacggccuaaauaccuuuacaaacauggaggcccagcuuauucgucagauggagagugaaggcaucuucucucccagcgagcuggaaacuccuaaccucgcugagcgaguccuggacugguuggaaaaguaugggguugagcgcuuaaaaagaauggccaucuccggagaugacugcgugguaaagccaauugacgaucgguuugcaaccgcucugacggcccucaaugacauggguaaagugaggaaggauauaccccagugggagccgucaaagggcuggaacgacuggcaacaggucccuuucuguagucaucacuuucaccagcuuaucaugaaagaugggcgcgaaauugugguucccugcagaaaucaggacgagcuggugggacgggcaagggucucucaaggcgccgguuggagccuacgagaaaccgcgugucuggggaaguccuacgcucagauguggcagcucauguauuuccaucguagagauuugcgccuggccgcaaacgccaucugcucagcugugccaguagacuggguuccuacaagccggacuaccuggucuauucacgcccaucaccaauggaugacaacugaggauaugcuuuccguguggaauagggucuggaucgaagagaaccccuggaugaaagacaagacccauauaaguagcugggaggaugugccauaccugggaaaaagagaagaccagugguguggcucgcucaucggcuuaacggcacgcgcuacaugggccaccaauauucagguugcgaucaaccaggugcggaggcugauugggaaugagaacuacuuggacuauaugacuuccaugaagcgauuuaagaaugaaucugaucccgagggagcucugugguga

SEQ ID NO: 13186 - RNA, 9879 nt, Artificial Sequence
  derived and/or modified CDS sequence (opt3) from DENV-1__LC128301__SS-prME
agcgugaccaugcugcucaugcuucugcccaccgccuuggcuuuccacuuaacuacgaggggaggggaaccucauaugaucgucuccaagcaggaaaggggaaaaucucugcuauuuaagaccucagccgguguuaauaugugcacgcucauugccauggaccugggcgaacuuugugaagauacuaugaccuacaaaugcccacggauaacagaaaccgaaccggacgauguggacuguuggugcaaugcgacugagacauggguaaccuaugggacguguagucaaacuggagagcaccgccgagauaagcguagcguggcucuggcaccccaugucggcuugggucucgaaaccagaacagagacuuggauguccucugaaggggcauggaggcagauccagaaaguggagaccugggcccugcggcacccuggauucacaguuauugcucuguuucucgcccaugccaucggcaccucgauuacgcagaagggcaucauauucaucuuacugaugcuugugacuccaucaauggcuaugcgcugcgucgggauuggaaacagggacuuuguggaggguuugagcggcgccacauggguagauguugugcuggaacacgggaguugugucaccacuauggcgaaggacaaacccacacuagauaucgagcuccugaagaccgaagugacgaauccugcagugcuuaggaaacugugcauugaggccaagaucuccaacaccacaacugacucucgguguccaacccaaggagaagcuacauuggucgaggagcaggauacuaauuucguuugccgccgaaccuuuguggaccggggcugggguaacggguguggacucuucggcaaaggcagccugauaacaugcgccaaguuuaagugcguaaccaaauuagaagggaagauugugcaguacgagaaucugaaauauuccgucaucgugacuguucacacgggagaucagcaucaaguggguaacgaaacaaccgagcacggcacuaccgcaacaauuacaccccaggcuccuacuucagaaauccagcucacagacuacggggcccuuacgcuggacuguaguccaaggaccggauuggauuucaaugagaugguccuacugacuaugaaggagaaaagcuggcucgugcauaagcagugguuucuggaccuuccgcugcccuggacaucuggcgcguccaccucacaagaaacauggaaccggcaggauuugcucguaacuuucaaaaccgcccacgcaaagaagcaggagguugugguccuggguagccaagaaggggcuaugcacacggccuuaaccggcgcuacagagauccagacaaguggaaccacaacuauuuuugccggccaucugaaaugccgucuaaagauggacaaacucacccugaagggggugucuuaugucauguguacgggauccuucaaacuugaaaaggagguggcagagacacagcacgguaccguuuuggugcagguaaaguacgaaggcacugaugccccuugcaaaauaccauucagcucgcaagacgagaagggggucacacagaauggacgccugaucaccgcuaaccccauugugacugauaaagaaaagccuguuaauaucgaggcggagccacccuuuggcgaaucuuaucucguggucggugcaggggagaaagcccugaaacuuuccugguucaagaaaggcucaaguauaggaaagauguuugaagcuaccgccagaggcgcaaggcggauggccauucugggggacacagcuugggauuucggaagcaucgguggcguguuuacguccguagggaaauugauccaucagauuuucggaaccgccuacggcgugcucuuuucugguguuagcuggacuaugaagaucgggauuggcauacuguuaacauggcugggacuaaacucacgaaguaccucccucagcaugacauguaucgcagucggcauggugacucuguaccuuggggugaugguccaggcggacucuggaugcguuauuaauuggaaaggccgcgaguugaagugugguucagggaucuucgugaccaacgaagugcacacguggacagagcaauauaaguuucaggcugauaguccgaaaagacugagcgccgcaaucggaaaggccugggaggaaggcguaugcgguauuagguccgcuacccggcucgagaacauaauguggaaacagaucucuaaugaacugaaccauauuuuacuggagaaugacaugaaguucacugucgugguuggcgacgugaacgggauccuugcccagggcaagaagaugauucgcccucaacccauggaacacaaauacucguggaaaagcuggggcaaggcaaaggucaucggggcugaugugcagaauaccacauuuauaaucgacggaccaaacacuccugagugucccgaugaccagagagccuggaauauuugggagguugaagauuauggcuucgguaucuuuaccacaaacauuugguugaagcucagggacuccuacacacaggugugcgaucaccgucugaugucagcggccaucaaagacaguaaggcuguacaugcagauaugggguauuggauagagucugagaagaaugagaccuggaagcuaacucgggccagcuucauugaagucaagacauguaucuggccaaaaucccacacccuguggucaaacggagugcucgagagcgagaugauuauccccaagacuuacggcgguccuauaucucaacauaauuaucgaccaggcuacuucacacagaccgcugggccguggcaccugggaaaacuugaauuggacuuuggccugugcgaggggacgacuguggucguugaugaacacugcggaaacagaggccccuccuuaaggaccacaaccgugacugguaagaucauucaugagugguguugccgcaguuguacacucccuccacugcgguucaaaggggaggacggaugcugguacggcauggaaaucagacccguaaaggagaaggaagagaaucuugugaggagcauggucucugccgguuccggcgaaguggauucauuuagucugggguugcucuguauuagcaucaugauagaggagguuaugcgcucgcgauggucccggaaaaugcugaugaccggaacacuagcaguguuccugcuccugauuaugggccagcuuacuuggaacgacuugauccgucugugcaucauggucggggcgaaugccucugacaagaugggaaugggcaccacguauuuagcucucauggccacauuuagaaugaggccuauguucgcagugggucugcuuuuucgccggcugaccagcagagaaguucuacuccugacugugggguugucacuggucgcuaguguagaguuaccaaacucccucgaagaacugggagauggccuugccaugggcauuaugaugcugaaauugcucaccgacuuccaaucucaccagcugugggcagcccuacugagccuuacauuugugaagacuaccuucucccuccauuacgcuuggaaaacgauggcgaugauccugucaauuauauccuuguuuccccuguguaugaguacaaccucucagaagacuacaugguuaccgguucuccuggggucccuuggaugcaagccucugaccauguucuugaucacugaaaacaaaauuugggguagaaagagcuggccacucaaugagggcaucauggccguggggauugucucgauccugcuaucaucucugcuuaaaaacgaugugccccucgcaggaccucugauagcuggcgguauguugaucgccuguuauguaauuaguggguccagcgccgacuuaucucuggagaaggcugcagaagugagcugggaggaagaggccgaacacuccggagcgucacauaauauccucgucgagguucaggaugacggcacaaugaaaauuaaggaugaggaacgagacgauacccugacgauccuucugaaagcuacuuugcuagccauaaguggcguguaccccaugagcauuccagcaacccuguuugugugguauuucuggcaaaagaagaaacagcgcucugggguccucugggacacaccuucacccccagagguggaacgggccguucuggaugacggaaucuacagaauccuucagagggguuuacugggcaagagccagguaggggugggagucuuccaagagggcguguuucacaccauguggcacguuacacguggugcugugcucauguaucaggggaaacgcuuggagccgaguugggcaagcgucaagaaagaucugauuuccuacggaggcggcuggcgguuccaggggucuuggaacacuggagaagaggugcagguaauagccgucgaaccugguaagaaucccaagaacgugcaaaccgcgccaggcacguuuaaaacacccgagggggaaguuggagcuaucgcccucgacuucaagccuggcacuucggguagcccaauugugaauagagaggggaaaaucgucggacuguacggcaacggcgugguuaccacaucagggaccuauguguccgcaauugcccaggcuaaggccagucaggagggaccccuuccugaaaucgaggacgaagucuuuaggaaacgaaaucugacuauaauggauuugcauccggguucuggcaagacccggcgcuaccuaccagcaaucgugagagaggcuauuaagaggaaacugcggacacucguauuagcccccacgcgagugguugcgagcgaaauggccgaggcacugaaggggaugccuaucagauaucaaacuaccgcugucaaauccgagcacacaggaaaggaaauuguggaccuuaugugccaugccaccuucacuaugcgccugcucucaccagugaggguccccaacuacaauaugaucauaauggaugaggcucacuuuacagacccugcaucuauugccgcccguggcuauaucagcacccggguagguaugggggaagcugcggcaaucuucaugacggccacuccgcccggaaguauggaggcuuuuccacaguccaacgccgcaauucaggaugaagagagagacaucccugagaggagcuggaacucuggcuacgauuggauaacagacuuccccggcaaaaccgugugguuuguuccaucaauuaaguccgggaacgauaucgccaauuguuugcgcaagaacggaaaacgagugguccagcugaguagaaagaccuucgacacugaauaucaaaagacuaagaacaaugauugggacuacgugguuaccacagacauuagcgagaugggugcuaacuuccgggcggauagggugaucgacccucgccguugccucaaacccgucauacugaaggauggcccagaaagagugauucuugccgggccgaugccuguaacuguggcaucggcugcccagcggaggggacgcaucggccgaaaucagaacaaggagggugaccaguacaucuauauggggcaaccccuaaauaacgaugaggaccaugcacacuggacggaagccaaaaugcuguuggauaauauuaacaccccagagggcaucauucccgcuuuauuugaaccugagagagaaaagucugccgcgauagacggagaguaccggcugaggggcgaggcacgcaaaacauucguugaacucaugagaagaggggaucugccagucuggcuuuccuauaagguggccagcgagggauuucaguacucagaccggcguuggugcuucgauggugaacgcaauaaccaggugcuggaggaaaauauggacgucgagaucuggacuaaagagggcgaacgaaagaaacucagacccaggugguuggaugcucggaccuauagugacccucuggcccuacgcgaguuuaaggaguucgcugcagggagaaggucuguuuccggagaccugauucucgagaucggcaaacuuccgcagcaccugacacaacgggcccagaacgcuuuagauaauuuggugaugcugcauaacagcgaacagggugggaaagccuaccgacacgcaauggaggagcucccagacaccaucgaaacucugaugcuucuggcgcucauugccguauugacgggcggagugacccuguuuuucuuaucaggcagagggcuaggaaagacaaguauaggucugcucugugucauggcuagcuccgcccuucuguggauggcaucuguggagccccauuggaucgcugccagcauuaucuuggaauuuuuccugaugguucuccugauuccugagcccgaucgccagaggacuccacaagacaaucagcuugcauauguggucaucggccuccuguuuaugauauugaccguagccgcuaacgagauggggcuguuagaaacaaccaaaaaggaucuaggaaucggccacguggcggccgagucccaccaucacgcagcuaugcuggacguugaucuccauccugccucagccuggacucuuuacgcaguggcuacaacgauuaucacccccaugaugcggcacacuauugaaaacacaaccgccaauaucucucugaccgcgauagcuaaccaggccgcaauuuugaugggucuggacaaaggguggccaaucaguaagauggauauuggcgucccucuccuggcccuuggaugcuacucgcaagugaauccguuaacacugacugcugcaguccucauguugguggcccauuaugcgaucauaggccccgggcugcaggcuaaggccacgcgugaggcacagaaaagaaccgccgcuggaaucaugaagaacccaacaguugacggcauuguggccaucgaucuagacccuguaguguacgaugcaaaauucgaaaagcagcugggucaaauuaugcuccuuauccuguguacuagccagauauugcugaugaggaccacaugggcucucugcgaguccauuacccuggccacugggcccuuaacgacacuuugggagggaucuccaggcaaauuuuggaauaccacuaucgcggucucaauggccaacaucuuccgcgguagcuaucuggcaggcgcugggcucgccuucucccuaaugaagagucugggaggcgggcggcgaggaaccggcgcacagggugaaacauugggggagaaguggaaaagacagcugaaucaacucucuaagagcgaauuuaacacuuacaaaaggucaggaauuauggagguugaccgcuccgaagcuaaggagggccuuaaacggggugagaccacaaagcacgccgugaguagaggcacggccaagcugcguugguucgucgaaaggaauuuggugaaaccugaggggaagguaaucgaccugggauguggcagagggggauggagcuauuacugcgcgggccucaaaaaggugaccgaaguuaaagguuauacuaaagggggacccggccacgaggaaccgauaccaauggcuacauacggcuggaacuuagugaaacuguacucugggaaggaugucuuuuucaccccucccgagaagugugacacucuucugugcgauauuggagaguccucaccaaaucccacaaucgaagagggucgcacccuacgagugcucaaaauggucgaaccuuggcugagaggcaaccaguuuuguauuaagguguugaauccguauaugcccagcguuguagagacgcuggagcagaugcagaggaaacaugggggaaugcucgugcggaacccacuuucgcgcaauucuacccacgaaauguacugggucaguugcggcacagguaacaucguguccgcaguuaauaugacuagcagaaugcuguuaaacagguucaccaugacacaucgaaagccuacuuaugagaaagacguggaucugggggccggaacccggcacgucgcuguggaacccgagguagccaacuuggacauaaucggccaacguauugaaaauaucaagaacgagcacaagucaacauggcauuacgaugaggacaauccuuauaaaaccugggcauaccacggcuccuaugaagugaagccaucugggagcgccaguuccaugguuaacggagucgugagacuccugacuaaacccugggaugugauuccuauggucacgcagaucgcuaugacagacaccacuccauuuggucagcaacgcguuuucaaggagaaaguggauaccaggacacccaaggcgaagcggggcacggcccagauuauggaaguaaccgcaagauggcuauggggguuucuuagccgcaauaaaaagccgaggaucuguacucgagaggaguucacacggaaagugagaucuaacgcugccauaggagcagucuuuguggacgagaaucaguggaacucagccaaggaggcuguugaagacgagagguucugggaucuggugcaucgcgaacgugagcuccacaaacagggcaagugcgcaaccugcgucuacaauaugauggguaagcgggagaaaaagcugggggaguuuggaaaagcgaagggcaguagagcaauuugguacaugugguugggcgccagguuccuggaguucgaagcucucggguuuaugaacgaggaccauugguucucccgcgaaaauagccuuucuggaguggagggugagggccugcacaaauuaggguauauccugcgagauaucucgaagauuccuggaggcaacauguacgccgacgauacugcagguugggacacacggauaaccgaagaugacuugcaaaaugaggcuaaaaucacagauauuauggaaccagagcacgcccuccuggcuacuucaaucuuuaagcuaaccuaucagaacaagguaguuagagugcagaggcccgccaaaaaugggacggucauggacgugauuagccgcagagaucagcggggauccggccaagugggcaccuacgggcuuaacacauucacuaacauggaagcacagcugaucaggcagauggagagugagggaauauuucucccuucugaacuggagaccccaaauuuggcggaacgugucuuagacuggcuggagaagcaugguacagaacgacucaaacgcauggccaucagcggcgaugacuguguugugaagcccauugacgauagauucgcuacugcccuuaccgcacugaacgacauggggaaaguacggaaggauaucccgcagugggagccuuccaagggauggaaugacuggcaacaggugcccuuuugcucacaccauuuccaccagcuaauuaugaaagauggcagggagaucgucgugccaugucgcaaccaggacgaacugguugguagagcucgggugagucaaggggccggauggucucucagggagacggcaugcuugggcaagagcuaugcccagauguggcagcugauguacuuucaccgacgugaucuuagacuggcggcuaaugccauauguuccgcagucccuguggacuggguacccacaucacgcaccacuuggagcauucaugcccaccaucaauggaugacaaccgaagauaugcucucuguuuggaaccggguguggaucgaggaaaauccauggauggaggacaaaacucacgucuccaguugggaggaugugcccuauuuaggcaagagggaagaccaguggugcgggagccugaucggauugaccgcuagagccacaugggcaacgaacauucagguugcuauaaaucaggugcgccggcugaucgguaacgagaauuaccucgacuacaugaccucgaugaaaagguucaagaacgaauccgauccugagggcgcccuuugguga

SEQ ID NO: 13187 - RNA, 9879 nt, Artificial Sequence
  derived and/or modified CDS sequence (opt3) from DENV-1__LC011945__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaagaagaugauccgcccucaacccauggagcacaaauacucguggaaaagcuggggcaaggcgaagauaaucggggccgacgugcagaauacuaccuuuauuaucgauggaccaaacacaccugaaugucccgacgaucagagagcuuggaauauuugggaggucgaggacuauggcuucgguaucuuuacuaccaacauauggcuuaaguugagggauuccuacacacaggugugcgaccaccgucucaugucagcagccauuaaagauaguaaggcuguucaugccgacaugggguauuggaucgaaucugagaaaaaugaaacguggaagcuggcacgggcgagcuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgccgggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguacagaggugaggacgggugcugguauggaauggagauaaggcccguuaaagaaaaggaggaaaaucuggugaaguccaugguaucugcuggcuccggugagguggacucauucagucuuggccuguuguguauuagcaucaugaucgaagaggucaugcgcucgcgauggucccggaaaaugcucaugaccgggacucuggccguguuuuuccuacugauuaugggacagcucacauggaacgaucugauccgucuuugcauuaugguuggcgcaaaugcuucugacagaauggggaugggaaccacauacuuggcccugauggcaacuuuuaagaugaggccuauguucgccgugggcuuacucuuucgccggcugaccagcagagagguccuucugcuaacgauaggucucucacugguggcuaguguugaauugccaaacucccuggaggaauuaggggauggacucgcgaugggcaucaugauucugaaacuucugacagacuuccaaucucaccaguugugggccacccuccugagccuaacuuuuaucaagaccacauucucccugcauuaugcauggaaaacuauugcuauggugcuuucaaucgucagccucuuuccccuguguuugaguaccacgucucagaagacaaccuggcugccgguauuacucggcucccuggggugcaagccucuuacuauguuccugauagccgagaauaaaaucuggggaagaaagagcuggccauugaacgaagguauuauggccgugggcaucguuucgauucuccugucaucucuacugaaaaacgaugugccccuugcugggccucucaucgcaggaggcaugcugauagccuguuacgucauuagugguuccagcgcggacuugucuuuagagaaggcugccgaggugagcugggaagaggaagcagagcacuccggggccucacauaauauccugguagaagugcaggaugacggaacaaugaaaaucaaggaugaggagcgagacgauacccucacuauucugcuuaaagcuacacuguuggcagucaguggcguuuauccccuaagcauaccagccacccuguuugugugguacuucuggcaaaagaagaaacagcgcucuggcgugcucugggacacgccuucacccccagaagucgagcgggcggugcuggaugacgggaucuauagaauuaugcagaggggacuuuuaggucguagccagguuggcguagggguguuccaagaaaacgucuuucacacuauguggcacgugacccgcggagcuguucugauguaccagggcaagcggcucgagccgaguugggccagcgugaaaaaggacuugaucuccuacggugggggauggagacugcagggcucuuggaauacaggcgaggaaguccaggugauugcaguagagccugggaaaaaccccaagaauguccaaaccgccccaggaacauucaagacucccgaaggugaggugggcgcuaucgcccucgauuuuaaaccugggaccucgggaagcccaauaguuaacagggaaggcaagaucgugggucuguaugggaauggagucgugacgacaucaggcacuuacguuuccgcaauugcucaggccaaagcgagucaggagggcccccuuccugagaucgaagacgagguguuccgaaagcggaaccugaccauuauggauuugcauccggggucuggaaaaacacgcagauaucuaccagccaucgucagggaagcaauaaagcggaagcugcgaacccucauuuuagcucccacuagagugguagccagcgagauggcugaagcacugaaagguaugccuauccgcuaccaaaccacagccgugaaguccgagcacacgggcaaagagaucguugaccuuaugugccaugccacuuuuaccaugaggcugcucucaccaguccgugugcccaauuauaacaugauuaucauggaugaagcucacuucacagacccuucuagcauagcggcacggggguacauuaguaccagagugggaaugggcgaggccgcugccaucuuuaugacugcaacaccgcccgguuccgucgaagccuucccacagagcaaugcuguaauucaggaugaggaaagggacaucccugagcgcucuuggaacucaggguaugaguggauaaccgauuuucccggaaagacggugugguucguuccauccauuaaaaguggcaaugacaucgcgaacuguuugcgaaagaauggcaagagagugauccagcugagccggaaaacuuuugauacagaauaccaaaagaccaaaaacaacgacugggacuacgucgugaccacugauauuucggagaugggggccaauuucagggcagaccgcguuaucgauccucguagaugccucaagcccgugauucugaaagacggaucugaacgggucauacuugcugguccaaugccggugacaguagccuccgcagcccagaggcgcggccgaaucgggagaaaccauaauaaggagggagaucaguauauuuacaugggccagccucuaaacaaugacgaggaucacgcucacuggaccgaagccaagaugcuguuggacaacaucaauacacccgaggguaucauuccagcguuauucgaacccgagcgggagaaaagcgcagccauagauggggaguauaggcugcgcggcgaggcuagaaagacuuuuguggaacucaugaggcggggagaccugccuguuuggcuuucauacaaagucgccagugagggcuuccaauauucugaucgucgcuggugcuuugacggggaacgaaacaaucaggugcuggaggaaaacauggauguggagaucuggacgaaggagggagaaaggaaaaagcucaggccacggugguuggacgcucgcaccuacuccgacccccuggcacuaagagaguucaaagaauuugccgcugguaggcggagcgucucaggcgaucugauucucgagaucgggaaacuuccucagcaucugacacagcgagcccaaaaugcauuagacaacuugguuaugcugcacaauagugaacagggaggcagagcguaucgccaugccauggaggagcucccggauacuauugaaacccugaugcuucuggcucucaucgccguguugacaggugggguaacccuguucuuuuuaagcggcaagggacuaggcaaaacuuccauagggcugcucugugugauggcaucuagcguccuucuguggauggcuuccguggagccacacuggaucgccgcaucaauuaucuuggaguucuuucugaugguucuccugauucccgagccugacaggcagcggacgccccaggauaaccaacuugccuacguggucaucggacuccuguucaugauauugaccguagcugcgaaugagaugggucuguuagaaacaacuaagaaagaccuaggcauugggcacguggccguugagaaccaucaccaugcagcuaugcuggauguggaccuccacccagccucugccuggacccuuuacgcagucgcuacaaccaucauuacuccuaugaugcgucauacaaucgaaaacacgaccgccaauauaagucugacugcgaucgcuaaccaggccgcaauuuugaugggacuggauaagggcuggcccaucucgaaaauggacauuggugugccacuccuggcccuugggugcuauagccaggucaauccuuuaacacugaccgcugcagugcucauguugguugcccacuacgcgaucauaggcccgggacugcaagcuaaggccaccagagaggcacagaagaggacagccgcuggcauuaugaaaaaccccacuguggaugggaucguagccaucgaccuagauccaguggucuaugacgcaaaguuugaaaaacagcugggacagauuaugcuccuuauccuguguacgucccaaauauugcugaugcgcaccacaugggcucucugcgagucuauuacucuggccaccggcccuuuaacaacccuuugggaggguucacccgggaaguucuggaauacuacgaucgcgguuagcauggccaacauuuuucggggauccuaccuggcaggcgcuggucucgccuucagucuaaugaaaucucugggcgggggacgaagaggcacaggggcacagggagaaaccuugggcgagaaguggaagaggcagcugaaucagcucagcaaaucagaguucaacacuuauaagcgcuccgguaucauggagguggaccggagugaagcuaaagaggggcuuaagagaggagagaccacaaaacacgccgucagccguggcacugccaagcugaggugguuuguggaacggaauuugguaaagccagaggguaaagugauagaucugggcugugggcgcggaggcuggucuuacuauugcgcggggcucaagaaaguuaccgaagugaagggauacacaaaaggcgguccugggcaugaggaacccgucccgauggcuacguacggauggaacuuagugaagcugcacuccggcaaagacgucuucuuuaucccaccugagaagugugauacccuucugugcgacauuggcgagucaagccccaauccaacuaucgaagaggggcgaacacuaagagugcucaagaugguugaacccuggcugaggggaaaccaauucuguauuaaaaucuugaauccuuauaugccgucgguaguggagacccuggagcagaugcagcggaagcaugguggcaugcucguccgcaacccccuuucuagaaauaguacucacgaaauguacuggguguccugcgggacaggaaacauuguuagcgcaaucaauaugaccucaaggaugcuguuaaaccgauuuacgauggcccaccggaaaccaaccuaugagcgugauguggaccugggcgcugguacaagacaugucgccguggaaccugagguagcaaacuuggauauaauugggcagcgcaucgaaaauaucaagugugagcacaaauccacuuggcauuacgacgaggauaaccccuauaagaccugggccuaccacggaucuuaugaagugaagccuagcggcagugcuuccagcaugguuaauggcgucgugaaacuccugacaaagccaugggacgugauucccauggucacucaaauagcgaugaccgauacaaccccuuucgggcagcagaggguuuuuaaagagaagguggacacucggacgccaaaagccaagagaggaacagcacaaaucauggaaguaaccgcucgcuggcuaugggguuuccuuucuaggaacaagaaaccccgaauuugcacucgggaggaauuuaccagaaaggugaggucaaaugccgcaaucggcgccgucuucguggacgagaaccaguggaauagugcuaaagaggccguugaagaugagcgcuuuugggaccuggugcaucgugaacgggagcuccacaagcaggggaaaugcgcgacaugugucuacaacaugaugggaaagagagaaaagaaacugggcgaguucgguaaggcaaaaggguccagggccauuugguacaugugguugggagcucgcuuucuggaguucgaagcccucggcuucaugaaugaggaucacugguuuagccgagaaaacucucuuucgggcguggagggggagggacugcauaaguuagguuauauccugcgggacauaucaaaaaucagcggcgggaauauguacgcagaugacacggcuggaugggauaccagaauuacugaagacgauuugcagaacgaggccaagaucacagaaauuauggagccggaacacgcucaacucgccaaagcaaucuucaagcugaccuaucagaauaagguaguuagggugcagcgcccugcgaaaaacggcacugucauggacgugauauccagacgggaucagagggguagugggcaagugggaacauacggccuaaauaccuuuacaaacauggaggcccagcuuauucgucagauggagucugaaggcaucuucagcccauccgagcuggaaacucccaaccucgcugagcgaguccuggacugguuggaaaaguaugggguugagcgcuuaaaaagaauggccaucucaggagaugacugcgugguaaagccuauugacgaucgguuugcaaccgcucugacggcccucaaugacauggguaaagugaggaaggauauaccacagugggagcccaguaagggcuggaacgacuggcaacaggucccguucuguucucaucacuuucaccagcuuaucaugaaagaugggcgcgaaauugugguuccuugcagaaaucaggacgagcuggugggacgggcaagggucagccaaggcgccgguuggucccuacgagaaaccgcgugucuggggaagucauacgcucagauguggcagcucauguauuuccaucguagagauuugcgccuggccgcaaacgccaucugcagcgcugugcccguagacuggguuccaacaucucggacuaccugguccauucacgcccaucaccaauggaugacaacugaggauaugcuuaguguguggaauagggucuggaucgaagagaacccuuggaugaaagacaagacccauauaagcucgugggaggaugugcccuaccugggaaaaagagaagaccagugguguggcucccucaucggcuuaacggcacgcgcuacaugggccaccaauauucagguugcgaucaaccaggugcggaggcugauugggaaugagaacuacuuggacuauaugacuucuaugaagcgauuuaagaaugaaucagauccagagggagcucugugguga

SEQ ID NO: 13188 - RNA, 9879 nt, Artificial Sequence
  derived and/or modified CDS sequence (opt3) from DENV-1__LC011949__SS-prME
agcgugaccaugcugcucaugcuuguccccacagcccuggcuuuccacuugacuacgagaggcggggagccucauaugaucguuuccaagcaggaaaggggaaaaucuuuacuguuuaagaccucagcaggugugaacaugugcacacuaauugccauggaccucggcgagcugugugaagauacuaugaccuacaaaugcccacggauaacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauccagaggguugaaacuugggcucuccggcacccuggauucaccgugauugcacuguuucuggcccaugcuaucggcacaucgauuacccagaagggcaucauauucauccucuuaaugcuggucacgccaucaauggccaugcgcugcguggggauuggaagcagagauuuuguagagggucuuaguggcgcgacuuggguugacguggucuuggagcacggguccugugugacaaccauggcaaaggauaaacccacucuggacaucgaacuacucaagacagaggugaccaacccugccguccugaggaaacuuugcauugaagcuaagaucucuaauacgaccacagauagccgguguccaacucaaggagaggccacccugguugaagagcaggacgcaaacuucgugugccgccgaacauuuguagauagaggcugggguaauggguguggauuguucggcaaaggcucccucauaacuugcgcuaaguuuaagugcgugaccaaacuggaggggaagauuguccaguacgaaaacuuaaaauauucagugaucguuacagugcacaccggagaccagcaucaagucgguaaugagaguacugaacacggcacgacagccaccauuacuccccaggcgccuaccacagagauccagcugaccgacuacggggcccucacucuugauuguagcccaaggacaggacuggacuucaacgaaaugguguugcuaacgaugaaggagaaaucuuggcugguacauaagcagugguuucucgaucugccgcuucccuggaccuccggcgcaucaacuagccaagagacauggaaucggcaggaccuguugguuaccuucaaaacagcucacgccaagaagcaggaaguggucgugcucgguagucaagagggggcuaugcacacugcccugaccggcgcaacggaaauccagaccucuggaacaacuaccauuuuugccggccauuuaaaaugccgucugaagauggauaaacuaacacucaaggggacuuccuaugucauguguaccggaagcuucaaacuggagaaggaaguggcugagacgcagcacgguacaguucuugugcagauaaaguacgagggcaccgacgcgccuugcaaaaucccauucucgacucaagaugaaaaggggguaacacagaacggacgcuugauuaccgcaaaucccaucgucacugacaaagagaagccugugaacauagaagccgagccacccuuuggcgagucuuauauuguuaucggugcuggggaaaaagcccugaagcucuccugguucaagaaaggcucaaguaucggaaagauguuugaggcaaccgccagaggcgcuaggcggauggccauucugggggauacagcaugggacuucggaagcaucgguggcguguuuacguccgucgggaaacuugugcaucagauuuucggaaccgcguacggcguacuguuuucuggugugagcuggacuaugaagauagggaucggcguuuugcucacauggcugggauuaaauucacgaaguaccucccugagcaugacauguauugcugucggccuagugacucucuaccugggggugaugguccaggccgauaccggaugcguuaucaacuggaaaggccgcgaacuuaagugugguucugggaucuucgugacgaaugaggugcacacauggaccgaacaauauaaguuucaggcagacucaccgaaaagauugagugccgcuauuggaaaggccugggaggagggcguaugcgguauaaggagcgcaacucggcuggaaaacaucauguggaaacagauuuccaacgagcucaaucauauccuguuagaaaacgacaugaaguucaccgucgugguuggcgauguggcugggauucuggcccagggaaaaaagaugauccgcccucaacccauggaguacaaauauucuuggaagucguggggcaaggcgaaaauaaucggggccgacguccagaauacaacuuuuauuaucgauggaccaaacaccccugaaugucccgacgaucagagagcuuggaauauuugggagguggaggacuacggcuucgguaucuuuacaacgaacauauggcuuaaguugagggauagcuauacccagguuugcgaccaccgucucauguccgcagccauuaaagauucaaaggcugugcacgccgacaugggguacuggaucgaaagugagaaaaaugaaacuuggaagcuggcacgggcgucuuucauugagguaaagacauguaucuggccaaaaagccauacccuaugguccaacggaguccuggaaucagagaugauaauccccaagauuuauggcgguccuaucagccaacacaauuaccgaccaggcuacuucacucagacagccgggccguggcaucucggaaaacuggagcuugauuuugacuugugcgaaggcaccacggugguggucgaugagcacugcgggaacagaggacccucucugaggacuaccacaguuaccggcaagauuauccacgaaugguguugccgcuccuguacuuuaccuccacuccgguucagaggugaggacgggugcugguauggaauggagauaaggcccgugaaagaaaaggaggaaaaucugguaaagaguauggugagcgcuggcucuggugaggucgacuccuuuucacuuggccuguuguguauuaguaucaugaucgaagaggugaugcgcagccgauggucgcggaaaaugcucaugacagggacccuggccguuuucuuucuacugauuaugggacagcucacauggaacgaucugauccgucuuugcauuauggugggcgcaaaugcuuccgacagaauggggaugggaacuaccuacuuggcccugauggcaacguucaagaugaggccuauguuugccgucggcuuacucuuccgccggcugacaucuagagaggugcuucugcuaaccauaggucucagccugguugcuucaguggaauugccaaacagucuggaggaauuaggggauggacucgcgaugggcaucaugauucugaaacuucugacugacuuucaaucccaucaguugugggccacccuccugucucuaacauucaucaagacuaccuuuagccugcacuaugcauggaaaacgauggcuaugguccuuuccauuguaucacucuucccccuguguuugagcacaaccagucagaagacuacauggcugccgguguuacucggcucucuggggugcaagccucuuaccauguuucugaucgccgagaauaaaauauggggaaggaaguccuggccauugaacgaagguaucauggccguuggcauugugagcauccuccugucgucacuacugaaaaacgaugucccccuugcugggccucucauugcaggaggcaugcugaucgccuguuacgugauaucugguaguuccgcggacuugagcuuagagaaggcugccgagguaucuugggaagaggaagcagagcauagcggggccucccacaauauucugguggaaguccaggaugacggaacuaugaaaaucaaggaugaggagcgagacgauacacucaccauccugcuuaaagcuacgcuguuggcaguuucaggcguguauccccuaaguauuccagccacucuguucgugugguacuucuggcaaaagaagaaacagcgcagcggcguccucugggacaccccuucucccccagaaguggagcgggcgguucuggaugacgggauauauagaaucaugcagaggggacuuuuaggucguucccagguaggcgugggggucuuucaagaaaacguguuccauacaauguggcacguuacccgcggagcugugcugauguaccagggcaagcggcucgagccgucaugggccagugucaaaaaggacuugauuagcuacggugggggauggagacugcagggcuccuggaauacaggcgaggaagugcagguaaucgcagucgagccugggaaaaaccccaagaaugugcaaacugccccaggaaccuuuaagacgcccgaaggugagguuggcgcuauugcccucgauuucaaaccugggacaucuggaucgccaaucgugaacagggaaggcaagauagucggucuguaugggaauggagugguuacuaccagcggcacauacgugucagcaaucgcucaggccaaagcgucccaggagggcccccuuccugagauugaagacgaggucuuuaagaaacgaaaccugaccaucauggauuugcacccggggaguggaaagacucggcgcuaucuaccagccauugugagagaagcaaucaagaggaaacugcggacccucauauuagcucccacacgaguaguggccucugagauggcugaagcacugaaggguaugccuauuagauaccaaacgacugccguuaaaagcgagcauaccggcaaggagaucgucgaccuuaugugccacgccacauucaccaugcgccugcucuccccagugagggugcccaauuauaacaugaucauuauggaugaagcucauuuuacugacccuucaucuaucgcggcacguggguacauaagcacacgggucggaaugggcgaggccgcugccauuuucaugaccgcaacgccgcccgguaguguagaagccuuuccacaguccaaugcugugauccaggaugaggaaagagacauuccugagaggagcuggaacucuggguaugaguggaucacugauuuccccggaaaaacaguuugguuugugccaucaauaaaguccggcaaugacauugcgaacuguuugcgcaagaauggcaaacgagucauccagcugaguagaaagaccuucgauaccgaauaccaaaaaacuaagaacaacgacugggacuacgugguuacaaccgauaucagcgagaugggggccaauuuccgggcagacagggugauugauccucgccguugccucaaacccgucauccugaaggacggaccagaaagagugauucuugcugguccgaugccuguaacaguggccucggcagcccagcggaggggccgcauagggcgaaaccacaauaaggagggagaucaguauaucuacaugggccagccccuaaacaaugacgaggaucaugcucacuggacugaagccaaaaugcuguuggacaacauuaauacgccagaggguaucauccccgcguuauuugaaccugagagagaaaagucugcagccauugauggggaguaucggcugaggggcgaggcucgcaaaaccuucguugaacucaugagaaggggagaccugccagucuggcuuuccuacaagguggccagcgagggcuuucaauauucagaucggcguuggugcuucgacggggaacgcaacaaucaggugcuggaggaaaacauggaugucgagauauggacaaaagagggagaacgaaagaaacucagacccaggugguuggacgcucggacuuacagugacccucuggcacuacgcgaguuuaaggaauucgccgcugguagaaggucuaucuccggcgaucugauucucgagaucgggaagcuuccgcagcaccugacccagcgggcccaaaaugcauuagacaacuugguuaugcugcauaauagcgaacagggaggccgagcguauagacacgccauggaggagcucccagauacaauugaaacccugaugcuucuggcucucaucgccguguugacuggugggguaacgcuguuuuucuuaucaggccgcggacuaggcaaaaccaguauagggcugcucugugugauggcaagcuccguccuucuguggauggcuucuguggagccccauuggaucgccgcaagcauuaucuuggaauuuuuccugaugguucuccugauuccugagcccgacaggcagcggacaccacaggauaaccaacuugccuacguggucaucggacuccuguuuaugauauugacuguagcugcgaaugagaugggucuguuagaaaccacaaagaaagaccuaggcauugggcacguggccguugagaaccaccaucacgcagcuaugcuggauguggaccuccauccugccuccgccuggacccuuuacgcagucgcuacuacaaucauuacgcccaugaugcgucacaccaucgaaaacacuacagccaauauaucacugaccgcgaucgcuaaccaggccgcaauuuugaugggacuggauaagggcuggccaaucucuaaaauggacauuggugugccucuccuggcccuugggugcuauagucaggucaauccguuaacccugacagcugcagugcucauguugguugcccauuacgcgaucauaggccccggacugcaagcuaaggccacuagagaggcacagaagaggacggccgcuggcauuaugaaaaacccaaccguggaugggaucguagccaucgaccuagauccuguggucuaugacgcaaaguucgaaaaacagcugggacagauuaugcuccuuauccuguguacaucgcaaauauugcugaugcgcacuaccugggcucucugcgagagcauuacacuggccaccggccccuuaacuacgcuuugggaggguuccccagggaaguuuuggaauacaaccaucgcgguuucuauggccaacauuuuccggggaucauaccuggcaggcgcuggucucgccuucagccuaaugaaaucccugggcgggggacgaagaggcacuggggcacagggagaaaccuugggcgagaaguggaagaggcagcugaaucagcucaguaaaucugaauuuaacacauauaagcgcagcgguaucauggagguggaccggucagaagcuaaagaggggcuuaagagaggagagacuaccaaacacgccgucucccguggcacagccaagcugaggugguucguggaacggaauuugguaaagccugaggguaaagugauagaucugggcugugggcgcggaggcuggaguuacuauugcgcggggcucaagaaaguuacggaagugaagggauacaccaaaggcggucccgggcacgaggaaccgaucccaauggcuacuuacggauggaacuuagucaagcugcauagcggcaaagacguguuuuucauuccucccgagaagugugauacacuucugugcgacaucggcgagucuuccccaaaucccaccauugaagaggggcgaacucuaagaguccucaagaugguggaaccuuggcugaggggaaaccaauuuuguaucaaaauuuugaauccguauaugcccucaguuguagagacacuggagcagaugcagcggaagcacgguggcaugcucgugcgcaacccacuuagcagaaauucgacccaugaaauguacugggucucuugcgggacgggaaacaucgugagugcaguuaauaugaccuccaggaugcuguuaaaccgauucacaauggcccaccggaaaccuacuuaugagcgugauguggaccugggcgcugguaccagacacgucgccguggaacccgagguagcaaacuuggauauaauugggcagcgcaucgaaaauaucaagcaugagcacaaaagcacauggcauuacgacgaggauaacccuuauaagacuugggccuaccacggaucauaugaagugaagccauccggcucugcuagcaguaugguuaauggcgucgugaaacuccugaccaagcccugggacgugauuccuauggucacacaaauagcgaugaccgauacuacgccauuugggcagcagaggguuuucaaagagaagguggacacacggacccccaaagccaagagaggaacugcacaaaucauggaaguaaccgcucgcuggcuaugggguuuucuuuccaggaacaagaaaccgcgaauuuguacacgggaggaauucacgagaaaggugaggagcaaugccgcaaucggcgccgucuuuguggacgagaaccaguggaauucugcuaaagaggccguugaagaugagcgcuucugggaccuggugcaucgugaacgggagcuccacaagcaggggaaaugcgcgaccugcgucuacaacaugaugggaaagagagaaaagaaacugggcgaguuugguaaggcaaaagggucaagggccauuugguacaugugguugggagcucgcuuccuggaguucgaagcccucggcuuuaugaaugaggaucacugguucagucgagaaaacucccuuagcggcguggagggggagggacugcauaaguuagguuauauccugcgggacauaucuaaaaucccuggcgggaauauguacgcagaugacacugcuggaugggauacaagaauuaccgaagacgauuugcagaacgaggccaagaucacugacauuauggaaccagagcacgcucuccuggccaaagcaaucuuuaagcuaacauaucaaaauaagguaguuagggugcagcgccccgcgaaaaacggcaccgucauggaugugauaucgagacgggaccagagggguucagggcaggugggaacauacggccuuaauacuuucaccaacauggaagcccaacugauucgucagauggagagcgagggcaucuuucucccuuccgaacuggagacgccaaacuuggcugaacgagucuuagauuggcuggagaaguaugggguugaacgccucaaaagaauggccaucaguggagacgacugugugguaaagcccauugaugaccgguucgcaaccgcucuuacagcccugaaugauauggguaaagugaggaaggacauaccgcagugggagccuucuaagggcuggaacgauuggcagcaaguccccuuuugcagccaucacuuccaccagcuaaucaugaaagacgggcgcgagauugugguuccauguagaaaucaggaugaacuggugggacgggcaagggucucccagggcgccgguuggucacuccgagagacugcgugcuuggggaagaguuacgcucaaauguggcagcugauguauuuucaucguagagaccuucgccuggccgcaaacgccaucuguucugcugugccuguagauuggguucccaccagccggacaacuugguccauucacgcccaucaccaguggaugaccacggaagacaugcucucaguguggaauagggucuggaucgaggaaaacccauggauggaggauaaaacacauauaagcucuugggaggacgugcccuacuuaggaaagagagaagaccaauggugcggcucccugaucggcuugaccgcacgcgcuacuugggccacaaauauucagguugcgaucaaccaggugcggaggcugauugggaaugagaacuaccucgauuauaugaccaguaugaaacgauucaagaaugaaagcgacccugagggagcucuuugguga

SEQ ID NO: 13189 - RNA, 9879 nt, Artificial Sequence
  derived and/or modified CDS sequence (opt3) from DENV-1__HM469966__SS-prME
agcgugaccaugcugcucaugcuuaugcccacagcacuggcuuuccacuugacuacgaggggaggggagccucauaugaucgucuccaagcaggaaaggggaaaaucuuuacuguuuaagaccucagccgguguuaauaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucaugacuugcgcuaaguuuaagugcguaaccaaacuggaggggaagauagugcaguacgaaaacuuaaaauauucagucauugugacaguucacaccggagaccagcaucaaguggguaaugagaguacugaacacggcacgacagccaccaucacuccccaggcgccuaccacagagauucagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccaucuuugccggccauuuaaaaugccgucugaagauggauaaacuaacacucaaggggauguccuaugugauguguacugggucguucaaacuggagaaggaagucgcugagacccagcacgguacggugcuuguucagauuaaguacgagggcacagacgcgccuugcaaaauaccauucucgacccaagaugaaaagggggugacucagaacggacgcuugaucacagcaaaucccauuguaaccgacaaagagaagccugucaacaucgaagccgagccacccuuuggcgagucuuauauagugauuggugcuggggaaaaagcccugaagcucuccugguucaagaaaggcucaaguaucggaaagauguuugaggcaacugccagaggcgcuaggcggauggccauccugggggauaccgcaugggacuucggaagcauugguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguugcugggauccuggcccagggcaagaagaugauucgcccucaacccauggaguacaaauauucguggaaaagcuggggcaaggcgaagaucauaggggccgacgugcagaauacuaccuuuaucauugauggaccaaacacaccugaaugucccgacgaucagagagcuuggaauaucugggaggucgaggacuacggcuucgguauuuuuacuaccaacaucuggcuuaaguugagggauuccuauacacaggugugcgaccaccgucucaugucagcagccauaaaagauaguaaggcuguucacgccgacaugggguacuggauugaaucugagaaaaaugaaacguggaagcuggcacgggcgagcuucaucgaggugaagaccuguauuuggccaaaaucccauacucuauggucaaacggaguacuggaaagcgagaugaucauacccaagaucuauggcgguccuauuucucaacacaauuaccgaccaggcuacuucacacagaccgccgggccguggcaucucggaaaacuggagcuugauuuugacuugugcgaaggcacuacagucgugguggaugagcacugcgggaacagaggacccucccugaggaccacgacugucaccggcaagaucauucacgaaugguguugccgcaguuguacauuaccuccacuccgguucagaggugaggacgggugcugguauggaauggagaucaggcccguuaaagaaaaggaggaaaaucuggugaaguccaugguaucugcuggcuccggugagguggacucauuuagucuuggccuguuguguauaagcauuaugaucgaagaggucaugcgcucgcgauggucccggaaaaugcucaugaccgggacucuggccguguucuuucuacugaucaugggacagcucacauggaacgaucugauucgucuuugcaucaugguuggcgcaaaugcuucugacagaauggggaugggaaccacauacuuggcccugauggcaacuuucaagaugaggccuauguuugccgugggcuuacucuuccgccggcugaccagcagagagguccuucugcuaacgauuggucucucacugguggcuaguguugaauugccaaacucccuggaggaauuaggggauggacucgcgaugggcauaaugauccugaaacuucugacagacuuucaaucucaucaguugugggccacccuccugagccuaacuuucauuaagaccacauuuucccugcacuaugcauggaaaacuauggcuauggugcuuucaaucgucagccucuucccccuguguuugaguaccacgucucagaagacaaccuggcugccgguauuacucggcucccuggggugcaagccucuuacuauguuucugauugccgagaauaaaaucuggggaagaaagagcuggccauugaacgaagguauaauggccgugggcaucguuucgauucuccugucaucucuacugaaaaacgaugugccccuugcugggccucucaucgcaggaggcaugcugauugccuguuacgucaucagugguuccagcgcggacuugucuuuagagaaggcugccgaggugagcugggaagaggaagcagagcauuccggggccucacacaauauacugguagaagugcaggaugacggaacaaugaaaauuaaggaugaggagcgagacgauacccucacuauccugcuuaaagcuacacuguuggcagucaguggcguuuauccccuaagcaucccagccacccuguucgugugguacuucuggcaaaagaagaaacagcgcucuggcgugcucugggacacgccuucacccccagaagucgagcgggcggugcuggaugacgggauuuauagaauaaugcagaggggacuuuuaggucguagccagguuggcguagggguguuucaagaaaacgucuuccauacuauguggcacgugacccgcggagcuguucugauguaccagggcaagcggcucgagccgaguugggccagcgugaaaaaggacuugaucuccuacggugggggauggagacugcagggcucuuggaauacaggcgaggaaguccaggugauugcaguagagccugggaaaaaccccaagaauguccaaaccgccccaggaacauuuaagacucccgaaggugaggugggcgcuaucgcccucgauuucaaaccugggaccucgggaagcccaauuguuaacagggaaggcaagaucgugggucuguaugggaauggagucgugacgacaucaggcacuuacguuuccgcaauagcucaggccaaagcgagucaggagggcccccuuccugagaucgaagacgagguguuucgaaagcggaaccugaccauuauggauuugcacccggggucuggaaaaacacgcagauaucuaccagccaucgucagggaagcaauuaagcggaagcugcgaacccucaucuuagcucccacuagagugguagccagcgagauggcugaagcacugaaagguaugccuauacgcuaccaaaccacagccgugaaguccgagcauacgggcaaagagauuguugaccuuaugugccacgccacuuucaccaugaggcugcucucaccaguccgugugcccaauuauaacaugaucaucauggaugaagcucauuuuacagacccuucuagcauugcggcacggggguacaucaguaccagagugggaaugggcgaggccgcugccauauucaugacugcaacaccgcccgguuccgucgaagccuuuccacagagcaaugcuguaauucaggaugaggaaagggacaucccugagcgcucuuggaacucaggguaugauuggauuaccgacuuccccggaaagacggugugguuuguuccauccaucaaaaguggcaaugauauagcgaacuguuugcgaaagaauggcaagagagugauucagcugagccggaaaacuuucgacacagaguaccaaaagaccaaaaacaacgacugggauuacgucgugaccacugacaucucggaaaugggggccaauuucagggcagaucgcguuaucgacccucguagaugccucaagcccgugauucugaaagauggaccagagcgggucgugcuugcugguccgaugccuguaacaguggccucugcagcccagaggcgcggccgaaucgggagaaaccacaauaaggaaggagaccaguauauuuacaugggccagccccuaaacaaugaugaggaccaugcucacuggaccgaggccaagaugcuguuggauaacauaaauacaccagaagguaucauucccgcguuauuugagccugaacgggagaaauccgcagccaucgacggggaauauaggcugcgcggcgaggcuagaaagacuuucguugagcucaugaggcggggagaucugccagucuggcuuagcuacaaaguggccucagaaggcuuucaauauagugaccgucgcuggugcuucgauggggagcgaaacaaucaggugcuggaagagaacauggacgucgaaaucuggacgaaggagggagagaggaaaaagcucaggccccggugguuggacgcucgcaccuacucugauccucuggcacuaagagaauuuaaagaguucgccgcugguaggcgguccguuagcggcgaccugauucucgaaauagggaaacuuccgcagcaccugacacagcgagcccaaaaugcauuagauaacuuggugaugcugcauaauucagagcagggaggcagagcguaucgccacgccauggaagaacucccagacacuaucgagacccugaugcuucuggcucucauugccguauugacagguggggugacccuguuuuucuuaaguggcaggggacuaggcaagacuagcaucgggcugcucugugucauggcauccucugugcuucuguggauugcuagcguugaaccccauuggaucgccgcauccauaaucuuggaguuuuuccugauggugcuccugauuccugaacccgaucggcagcguacgccacaggacaaccaacuugccuacgucguaaucggacuccuguuuaugauuuugaccguggcugcgaaugagaugggucuguuagagacaacuaaaaaggaucuaggcaucgggcacguugccguggaaaaccaccaucacgcagcuauacuggacgucgaucuccauccugccucagccuggacccuuuacgcaguggcuacaaccauuaucacucccaugaugagacacacaauugagaacacgaccgccaauaucucucugacugcgauagcuaaccaggccgcaaucuugaugggacuggacaaaggcuggccaauuaguaagauggauaucggugucccucuccuggcccuugggugcuauagccaggugaauccguuaacacugaccgcugcaguucucauguugguggcccauuacgcgauuaucggccccggacugcaagcuaaagccaccagggaagcacagaagcgcacagccgcuggcauaaugaagaacccaacuguagacgggauuguggccaucgaucuagacccugucguuuaugacgcaaaauucgagaagcagcugggacagaucaugcuccuuauucuguguacgagccaaaucuugcugaugcggaccacaugggcucucugcgaauccauaacucuggccaccggccccuuaacaacccuuuggaaagguucuccagggaaguuuuggaauacuacgauugcggugucaauggccaacaucuuccgaggaagcuaccuggcaggcgcuggucucgccuucucccuaaugaaaagucugggcgggggaagaaggggcacaggggcacagggagagaccuugggcgagaaguggaagcgccagcugaaucagcucucuaaaagcgaauuuaacacuuauaagcggucagguauuauggaggucgauagauccgaagcuaaagaggggcuuaagcguggagaaaccacaaaacacgccgugaguaggggcacugccaagcugcggugguucguagagcgcaauuuggugaagccugaggguaaaguuaucgaccugggcugugggcgaggaggcuggagcuacuauugcgcggggcucaagaaagugaccgaagucaagggauacacaaaaggcggucccgggcacgaggaaccgauaccaauggcuacguacggauggaacuuagugaagcuguauucuggcaaagaugucuuuuucaucccucccgagaagugugacacccuucugugcgauauuggcgaauccucaccaaaucccacuaucgaggaggggagaacacuaagggugcucaagaugguugaaccuuggcugcggggaaaccaauuuuguauuaaaaucuugaauccguacaugcccagcguaguggagacccuggaacagaugcagcgcaagcaugguggcaugcucgucagaaacccacuuucgagaaauucuacucacgagauguauugggugaguugcgggacaggaaacauuguuuccgcagugaauaugaccagccgaaugcuguuaaaccgguucacgauggcccaucguaaaccuaccuacgagagagacgucgaucugggcgcugguacacgccacguggccguagaacccgagguggcaaacuuggacaucauagggcagaggauugaaaauaucaagcacgagcauaaaucaacuuggcacuaugaugaagacaacccuuacaagaccugggccuaucauggauccuacgagguuaagccaucuggcagcgcuaguuccauggucaauggcguggugaaacuccugacaaagcccugggaugucaucccuaugguuacucaaauugcgaugaccgacacaaccccauuugggcagcagcggguguucaaagagaagguagacacuagaacgcccaaagccaagcgcggaacagcacaaauaauggaagugaccgcuagguggcuaugggguuuucuuagccgaaacaagaaaccgcggaucuguacuagagaggaguucaccaggaagguccgcucuaaugccgcaauuggcgccguguuuguugaugagaaccaguggaacucagcuaaagaagccguggaggacgagcguuucugggaucugguccaccgggaaagagagcuccauaagcaggggaaaugcgcgacaugcguguacaacaugaugggaaagagggaaaagaaacugggcgaguuugguaaggcaaaagggagucgcgccaucugguauaugugguugggagcucgauuccuggaguucgaggcccucggcuuuaugaaugaggaccacugguucucccgggaaaacagccuuucuggcguagagggggaaggacugcacaaguuagguuacauucugagagauaucucgaaaauaccuggcgggaauauguaugcagacgauacggcuggaugggacaccaggaucacugaggaugacuugcagaacgaggccaagauuacagauaucauggaaccagagcaugcucuccuggccaaagcaauuuuuaagcuaaccuaccaaaauaagguugugcgcguccagagacccgcgaaaaacggcacugugauggacgugaucucacggagggaucagcgugguagcgggcaggucggaacauauggccuuaauaccuucacaaacauggaagcccaacugauacgacagauggaguccgaaggcauuuuuaguccuucugagcucgagacuccaaaccuggcugaacgcguuuuggacugguuagagaaguacgggguggaaagacugaaacggauggccaucagcggagacgauuguguagugaagcccaucgacgauagguucgcaaccgcucucacggcccuuaaugacauggguaaaguccgcaaggauauuccgcagugggagccuuccaagggcuggaacgacuggcagcaagugcccuuuugcucacaccauuuccaccagcugauaaugaaagaugggagagaaaucguugugccaugucggaaucaggacgagcuagucggaagggcacgagugagucagggcgccgguuggucucugcgugagaccgcgugccucggaaagagcuaugcucaaauguggcaguugauguacuuucacagacgcgaucugcggcuugccgcaaacgccauuuguuccgcuguaccuguugacugggugcccacaucaaggacuaccuggagcauccaugcccaccaucaguggaugacaacugaagauaugcugucugucuggaauagaguguggauugaggaaaacccauggauggaggacaaaacccacaucuccaguugggaagacguucccuaccucggaaagcgcgaggaucaauggugcggcagcuuaauaggccugacggcacgggcuacaugggccaccaauauccagguggcgauuaaccaggucaggcgauugaucgggaaugagaacuaucuggacuacaugacuucgaugaaaagauucaagaaugaauccgauccugagggagcucucugguga

SEQ ID NO: 13190 - RNA, 9879 nt, Artificial Sequence
  derived and/or modified CDS sequence (opt3) from DENV-1__JX669462__SS-prME
agcgugaccaugcugcucaugcuucugcccaccgccuuggcuuuccacuuaacuacgagaggaggggaaccucauaugaucgucuccaagcaggaaaggggaaagucucugcuauuuaagaccucagccgguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaggcagauccagcggguggagacuugggcucugcgccacccuggauucaccguuauugcauuuuuccuggcccaugcuaucggcacaucgauuacccagaaaggcaucauauuuauccucuuaaugcuggugacgccaucaauggccaugagaugcgucgggauuggaaacagggacuucguggagggucuuagcggcgcgacuuggguagauguuguguuggaacacgggaguugugucacaaccauggcaaagaauaagcccacucuggacaucgagcuacucaaaacagaagugaccaacccugccgugcugcggaaacuuugcauugaggcuaaaaucuccaauacgaccacagauucucgcuguccaacucaaggagaagccacccuggucgaggagcaggacgcaaacuuuguuugccgaagaacauucguggauaggggcugggguaauggguguggauuguuuggcaagggcagccuccugacuugcgcuaaauucaagugcguaaccaaguuagaagggaaaauagugcaguacgagaaccugaaguauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccacggacuggauuggacuuuaacgagaugguccuacugacaaugaaagaaaagagcuggcucgugcauaaacagugguuccuggaucuuccgcugcccuggacgucuggcgcauccaccucacaagaaacuuggaaucgucaggacuugcucguaacauuuaagaccgcucacgccaaaaagcaggagguugugguccuggguagccaagaaggggcuaugcacacagccuuaacuggcgcaaccgagauccagacgaguggaaccacaacuauuuucgccggccaucugaagugccgccuaaaaauggauaagcucacccugaaagggaugucuuaugugauguguacaggauccuucaaacuugaaaaagaggucgcugagacucagcacgguaccguguugguucaggugaaguacgaaggcacggacgcgccuugcaagauaccauuuagcacacaagaugagaaagggguaacccagaacggaagacugaucacugcaaaucccauugucacagacaaggaaaaaccugugaacaucgagaccgagccacccuucggcgaaucguauauaguugugggugccggggagaaggcucucaaacugucuugguuuaagaggggcuccucaauuggaaagauguucgaagccacugcacggggcgcccgacgcauggcuauccuuggggauaccgccugggacuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagcagaucaacaagucuauccaugaccuguauagcggugggcauggugacacucuaccugggggucaugguucaggcugauagcggaugcgugaucaacuggaaaggcagggagcuuaagugugguucugggauuuuugugacuaacgaaguacacaccuggacggagcaauauaaauuccaggccgacucaccgaagcgguugagugcagccaucggaaaggcuugggaggaaggcgucugcgguauccgcagcgccacaagacuggagaauauuauguggaaacagauauccaacgaacucaaucauauccuguuagagaacgauaugaaguuuaccgugguugugggcgacgcaaaugggauucuggcucagggcaagaagaugaucaggccucaacccauggaacacaaauacucuuggaagucguggggcaaagccaagauuaucggggcggacauacagaacacuaccuucaucauugauggaccagacacaccugagugucccgauggccagcgugccuggaauaucugggaggucgaagacuaugguuuugggguguucacuaccaacauuuggcuuaaguugcgggauagcuacacacagaugugcgaccaccgacucauguccgcugcaaucaaagauucaaaggccguucaugcugacaugggauauuggauagagagugagaagaaugagacguggaagcuggccagagcaucuuucauugaagugaaaaccuguacuuggccaaagagccacacacuaugguccaacggcguacuggagucagagaugaucauucccaagaucuuugguggcccuauaagccaacauaauuacaggccaggguauuucacccagacugcgggaccguggcaccucggcaaacuggaacuugauuuugacuugugcgaggggacaaccgucgugguggaugaacacugcggaaaccgcggccccucucugcggacgacuaccgucacagguaagaucauucaugagugguguugcagauccuguaccuuaccuccacucagguuccgcggggaggacggaugcugguacggcauggaaauccgacccguuaaagagaaggaagagaaucuggugcggaguaugguaagcgccgguucuggcgaaguggauuccuuuucacuugggauucugugugucaguaucaugauagaggaggugaugcguagcagauggucgaggaaaauguugaugacuggaacacucgcuguuuuccugcuacugauuaugggccagcucaccuggaacgaccugauccgccuuugcaucauggugggggccaaugcauccgaccggaugggaaugggcacaacuuacuuggcucugauggccaccuuaaagaugagaccuauguuugcagucggucuccuguucaggcgacuuacgucucgcgaagugcugcuacucacaauugggcugagcuugguugccucaguggagcugccaaacaguuuagaggaacucggagauggccuggcuaugggcaucaugaugcuuaagcuguugaccgaauuucaaccccaccagcucuggacuacccugcuaucccugacauucgucaaaacuacccuuucucucgacuaugcguggaagacgacagccaugguacugagcauuguguccuuguuuccgcuguguuuaucaaccacuagccagaaaacaaccuggcucccuguucugcuugggaguuucggaugcaagccacugacuauguuuuugauaacagagaacaaaaucuggggucggaagucuuggccccucaaugagggcauuauggcaaucgggauuguguccauccugcuaagcucgcugcuuaagaacgaugucccucucgcuggaccccugauagccggcgguauguugaucgccuguuacgugauuucagggucuagugcugacuuaucccuggaaaaagcagccgagguaagcugggaacaggaggcggaacauucuggagcuagccacaauauccucguggagguccaagaugacggcaccaugaagauuaaagaugaggaaagagacgauacgcugacuauccuucugaaggccaccuugcuagcaguuuccggcguguauccaaugucaauaccugccacacuguucgugugguacuucuggcagaaaaagaaacagaggagugggguccucugggacacccccagcccaccggagguggaacgugcuguucuggaugacggaauuuaucgcauccuucagcgggguuuacugggcagaucucaaguaggggugggagucuuucaggauggcguguuccauacaauguggcacguuacuaggggugcagugcucauguaccaggggaagcgauuggagccuuccugggccucagucaagaaagaccugaucaguuauggaggcggcuggcgguuucaggggagcuggaacaccggagaggaagugcaaguaauugcggucgagcccgguaagaaucccaagaaugugcagacgacacccggcacuuucaagaccccugaaggggagguuggagcuauagcccucgacuuuaaaccaggcacauccgguucucccaucgugaaucgcgaagggaagauugucggacuguacggcaacggcgugguuaccacuucggggaccuacgugagcgcaaucgcccaggcuaaggccucacaagagggaccucuuccggagauugaagaugaggucuucaaaaagagaaaucugacaaucauggacuugcacccagguuccggcaaaacgaggcgguaucuacccgcaauagugcgagaagcuaucaagagaaaacugcgcacucucauuuuagccccuaccaggguaguggcgagugagauggccgaagcacugaaggggaugccaauccguuaccagacaaccgcuguuaagucugagcauacuggacgggagauugucgaucuuaugugccacgccacauuuaccaugagacugcucagccccgugagggugccuaacuauaauaugaucauaauggacgaagcucauuucacggauccggcauccauugccgcccgcggcuacaucucaacucgagucgguaugggggaggcugcggcaaucuuuaugacagccacaccaccaggaucuguagaggcuuucccucagagcaacgccgugauucaggacgaggaaagagauauccccgagcggaguuggaacuccggcuaugacuggauaaccgauuuuccaggcaaaacuguuugguucgugccuagcauuaagucugggaacgacaucgcaaauuguuugaggaaaaacggaaagcgcgucauucaacugucacguaaaacauucgauaccgaguaccagaagacaaagaacaaugacugggacuaugugguuacuacggauaucuccgaaaugggugccaacuuuagagcugaccgggugauagaucccaggcgcugccucaaaccagucauucugaaggacggcccggagcgagugauccuugcggggccuaugcccguaaccguggccagugcagcucagagacggggaaggaucggccgcaaucagaacaaagaaggugaucaauacguuuacauggggcagccacuaaauaacgacgaggaucacgcccauuggacagaggcaaagaugcuguuggacaauauuaacacucccgaaggcaucauuccugccuuauucgagccagaaagagagaaaagcgcugccauagauggagaauauaggcugcggggcgaggcgcguaagaccuuugucgagcucaugcgccgaggggaccugcccguguggcuuucguacaagguggcaucugaaggauuccaguauuccgauagaagguggugcuuugacggugagcggaauaaccagguccuggaagagaauauggauguugaaaucuggacaaaagagggcgagcgcaagaaacucagaccuaggugguuggacgcccggaccuacagcgacccgcuggcucuacgagaguucaaggaguuugccgcugggagacgcucagugaguggagaucugauucucgaaaucggcaaacuuccacaacaccugacuuuaagggcacagaacgccuuggacaaucugguaaugcuccacaacucugagcagggugggaaggcuuaucggcaugccauggaagaacugcccgauacgaucgagacccuuaugcugcucgcauugauugcggugcugacaggcggagucacuuuauucuuucuauccggcaaagggcugggaaagaccagcauaggucuccuuugugugacagccucaagugcucuguuguggauggccagcguugaaccucacuggaucgcagcuuccauuauccuggaguucuuucucauggugcugcuuauucccgaaccagaccgucagagaaccccucaagauaaucagcucgccuacgucguaaucggccuguuguucaugauacugacuguggcagccaacgagaugggguuacuagagacaacgaagaaagaccugggaaucggcuauguugcugcggaaaaccaucagcacgccaccaugcucgauguggaccuucaccccgcaucugcuuggacucuguacgccgucgccacaaccgugauuaccccaaugaugaggcauacaaucgagaauacuacggcaaacauuagcuugaccgcuaucgccaaucaagcggcuauacugaugggucucgauaagggguggccuauuuccaaaauggacaucggcgucccgcugcuugccuuaggaugcuacucacaggugaacccccugacacucacugcagccguuuugaugcugguggcucacuaugcaauuaucggcccagggcuacaggccaaggcgacccgcgaagcucagaaacggacagccgcaggaauaaugaagaauccuaccguagauggcaucguggccauugaccuggaucccgucguuuacgacgcuaaguuugagaaacaacucggucagaucaugcuucugauuuuguguacuucucagauccugcucaugcgaacgacaugggcccugugcgaaaguauaaccuuagcaacugggccacuuaccacacugugggagggaucgccuggcaaguucuggaacacuaccauugcugugagcauggccaauaucuucagagguuccuaucucgcgggcgccgggcuagcauuuucucugaugaaaucauugggaggcgggaggcgcggaacaggcgcucagggugagacgcugggggaaaaguggaaacggcaacucaaccagcuuagcaaguccgaguucaauaccuacaagagaaguggaaucauggaagucgaccguucugaggccaaagaaggccugaagaggggugagacuacaaaacaugcagugagccggggcaccgcuaaguugcgcugguuuguagagcgaaaccuggugaaacccgaagggaagguuauugaucucggauguggcagagggggauggucauauuacugcgccggcuuaaagaaagugacugaggucaaggguuauacaaaagggggaccgggccacgaagaaccaaucccuauggccaccuacggcuggaaucuggugaaacuucauuccgggaaagacgucuucuuuaugcccccagaaaagugugauacgcugcuaugcgacauaggagagaguagccccaacccuaccauugaggaagguaggacacuccgggugcugaaaaugguugagccgugguugcgcggcaaucaguucuguaucaagauucugaaccccuacaugccaucuguaguggaaacucucgagcagaugcaaagaaagcacgggggaaugcuugucaggaauccucugucccgaaacucaacccacgagauguauugggugagcugcggcacagguaauaucguuucggcggugaacaugacuucucggauguuacugaaccguuuuaccauggcucauagaaaacccacauacgaacgcgaugucgacuugggggcaggaaccaggcacguggccguagagccugaaguggcuaaucucgauauaaucggccagcggauugagaacaucaagaaugaacauaaaaguacuuggcacuaugacgaggauaacccauacaagacgugggccuaucacggcuccuacgagguuaaacccagcgggucagcauccucuauggucaauggaguggugagacugcuaacaaagccuugggacgucauuccaaugguuacccagaucgccaugacugauaccacacccuucggucaacagcgcguguuuaaggaaaaaguagacacgaggaccccgcgagcuaagcggggcacuacacagauuauggaggugaccgcgaaauggcuuuggggguuccugagcagaaacaagaaaccuaggaucuguacucgcgaagaguuuacacguaagguccggaguaaugccgcaauaggagcuguguucguugacgaaaaccaguggaacuccgccaaggaggcaguggaggaugaaagauuuugggaccucguccauagggagcgcgaacugcacaaacaaggcaagugcgcaaccugcguguauaacaugauggguaaacgagagaagaaauugggggaguucggaaaggcuaagggcagccgggccauuugguacauguggcugggcgcgagauuccucgaguuugaggcacuuggguucaugaaugaagaucauugguuuucuagggagaacucacugaguggaguagaaggugagggcuuacacaaacugggguacaucuugcgcgacaucuccaagauuccaggaggcaauauguaugccgaugacacagcugguugggauacuagaauaaccgaggacgaucuccagaacgaagccaaaaucacggacauuauggagcccgaacaugcacugcuagcuaccagcaucuucaaacuuacauaccagaauaaaguugugcggguccagaggccugccaagaacgggacugugauggaugugauuucucgucgagaccaacgcggaucgggccaggucggcaccuaugggcugaacacauuuacuaauauggagguucagcucaucagacagauggaaucagagggaauauuccugccaagcgaguuggaaacccccaacuuagcugagcgggcccuggauuggcucgaaaaacacggugcagagaggcuuaagcgcauggcgaucuccggcgacgacugugugguaaagccgauugaugacagauuugccacggcucugacagcccuaaaugauauggggaaagugcggaaggacaucccucaaugggaacccaguaaaggauggaacgauuggcagcaggucccauucugcucucaccauuuucaccagcugauuaugaaggacggcagggagaucgugguuccuugucgaaaucaagaugagcucgugggucgugcaagagucagccagggggcuggaugguccuugcgcgaaaccgccugccugggcaaaucauacgcacagauguggcaacuuauguauuuccaucggagggaccugagacucgccgcgaacgcuauauguagugccgugcccguagauuggguuccagcaucucgcacuacauggagcauucacgcccaccaucaguggaugaccacugaggacauguuauccguguggaaucgggucuggaucgaagagaaccccuggauggaagauaagacccacgugucaagcugggaggagguuccuuaccugggcaagagggaagaccaguggugcgggucuuugaucggacugacagcucgagccacgugggcaaccaauauucagguggcuauaaaccaagucagacggcucaucgguaaugagaacuaucuugacuacaugacuuccaugaaaagguuuaagaaugaaagugauccagagggcgcccugugguga

SEQ ID NO: 13191 - RNA, 9879 nt, Artificial Sequence
  derived and/or modified CDS sequence (opt3) from DENV-1__JX669463__SS-prME
agcgugaccaugcugcucaugcuucugcccaccgccuuggcuuuccacuuaacuacgagaggaggggaaccucauaugaucgucuccaagcaggaaaggggaaagucucugcuauuuaagaccucagccgguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaggcagauccagcggguggagacuugggcucugcgccacccuggauucaccguuauugcauuuuuccuggcccaugcuaucggcacaucgauuacccagaaaggcaucauauuuauccucuuaaugcuggugacgccaucaauggccaugagaugcgucgggauuggaaacagggacuucguggagggucuuagcggcgcgacuuggguagauguuguguuggaacacgggaguugugucacaaccauggcaaagaauaagcccacucuggacaucgagcuacucaaaacagaagugaccaacccugccgugcugcggaaacuuugcauugaggcuaaaaucuccaauacgaccacagauucucgcuguccaacucaaggagaagccacccuggucgaggagcaggacgcaaacuuuguuugccgaagaacauucguggauaggggcugggguaauggguguggauuguuuggcaagggcagccuccugacuugcgcuaaauucaagugcguaaccaaguuagaagggaaaauagugcaguacgagaaccugaaguauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccacggacuggauuggacuuuaacgagaugguccuacugacaaugaaagaaaagagcuggcucgugcauaaacagugguuccuggaucuuccgcugcccuggacgucuggcgcauccaccucacaagaaacuuggaaucgucaggacuugcucguaacauuuaagaccgcucacgccaaaaagcaggagguugugguccuggguagccaagaaggggcuaugcacacagccuuaacuggcgcaaccgagauccagacgaguggaaccacaacuauuuucgccggccaucugaagugccgccuaaaaauggauaagcucacccugaaagggaugucuuaugugauguguacaggauccuucaaacuugaaaaagaggucgcugagacucagcacgguaccguguugguucaggugaaguacgaaggcacggacgcgccuugcaagauaccauuuagcacacaagaugagaaagggguaacccagaacggaagacugaucacugcaaaucccauugucacagacaaggaaaaaccugugaacaucgagaccgagccacccuucggcgaaucguauauaguugugggugccggggagaaggcucucaaacugucuugguuuaagaggggcuccucaauuggaaagauguucgaagccacugcacggggcgcccgacgcauggcuauccuuggggauaccgccugggacuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagcagaucaacaagucuauccaugaccuguauagcggugggcauggugacacucuaccugggggucaugguucaggcugauagcggaugcgugaucaacuggaaaggcagggagcuuaagugugguucugggauuuuugugacuaacgaaguacacaccuggacggagcaauauaaauuccaggccgacucaccgaagcgguugagugcagccaucggaaaggcuugggaggaaggcgucugcgguauccgcagcgccacaagacuggagaauauuauguggaaacagauauccaacgaacucaaucauauccuguuagagaacgauaugaaguuuaccgugguugugggcgacgcaaaugggauucuggcucagggcaagaagaugaucaggccucaacccauggaacacaaauacucuuggaagucguggggcaaagccaagauuaucggggcggacauacagaacacuaccuucaucauugauggaccagacacaccugagugucccgauggccagcgugccuggaauaucugggaggucgaagacuaugguuuugggguguucacuaccaacauuuggcuuaaguugcgggauagcuacacacagaugugcgaccaccgacucauguccgcugcaaucaaagauucaaaggccguucaugcugacaugggauauuggauagagagugagaagaaugagacguggaagcuggccagagcaucuuucauugaagugaaaaccuguacuuggccaaagagccacacacuaugguccaacggcguacuggagucagagaugaucauucccaagaucuuugguggcccuauaagccaacauaauuacaggccaggguauuucacccagacugcgggaccguggcaccucggcaaacuggaacuugauuuugacuugugcgaggggacaaccgucgugguggaugaacacugcggaaaccgcggccccucucugcggacgacuaccgucacagguaagaucauucaugagugguguugcagauccuguaccuuaccuccacucagguuccgcggggaggacggaugcugguacggcauggaaauccgacccguuaaagagaaggaagagaaucuggugcggaguaugguaagcgccgguucuggcgaaguggauuccuuuucacuugggauucugugugucaguaucaugauagaggaggugaugcguagcagauggucgaggaaaauguugaugacuggaacacucgcuguuuuccugcuacugauuaugggccagcucaccuggaacgaccugauccgccuuugcaucauggugggggccaaugcauccgaccggaugggaaugggcacaacuuacuuggcucugauggccaccuuaaagaugagaccuauguuugcagucggucuccuguucaggcgacuuacgucucgcgaagugcugcuacucacaauugggcugagcuugguugccucaguggagcugccaaacaguuuagaggaacucggagauggccuggcuaugggcaucaugaugcuuaagcuguugaccgaauuucaaccccaccagcucuggacuacccugcuaucccugacauucgucaaaacuacccuuucucucgacuaugcguggaagacgacagccaugguacugagcauuguguccuuguuuccgcuguguuuaucaaccacuagccagaaaacaaccuggcucccuguucugcuugggaguuucggaugcaagccacugacuauguuuuugauaacagagaacaaaaucuggggucggaagucuuggccccucaaugagggcauuauggcaaucgggauuguguccauccugcuaagcucgcugcuuaagaacgaugucccucucgcuggaccccugauagccggcgguauguugaucgccuguuacgugauuucagggucuagugcugacuuaucccuggaaaaagcagccgagguaagcugggaacaggaggcggaacauucuggagcuagccacaauauccucguggagguccaagaugacggcaccaugaagauuaaagaugaggaaagagacgauacgcugacuauccuucugaaggccaccuugcuagcaguuuccggcguguauccaaugucaauaccugccacacuguucgugugguacuucuggcagaaaaagaaacagaggagugggguccucugggacacccccagcccaccggagguggaacgugcuguucuggaugacggaauuuaucgcauccuucagcgggguuuacugggcagaucucaaguaggggugggagucuuucaggauggcguguuccauacaauguggcacguuacuaggggugcagugcucauguaccaggggaagcgauuggagccuuccugggccucagucaagaaagaccugaucaguuauggaggcggcuggcgguuucaggggagcuggaacaccggagaggaagugcaaguaauugcggucgagcccgguaagaaucccaagaaugugcagacgacacccggcacuuucaagaccccugaaggggagguuggagcuauagcccucgacuuuaaaccaggcacauccgguucucccaucgugaaucgcgaagggaagauugucggacuguacggcaacggcgugguuaccacuucggggaccuacgugagcgcaaucgcccaggcuaaggccucacaagagggaccucuuccggagauugaagaugaggucuucaaaaagagaaaucugacaaucauggacuugcacccagguuccggcaaaacgaggcgguaucuacccgcaauagugcgagaagcuaucaagagaaaacugcgcacucucauuuuagccccuaccaggguaguggcgagugagauggccgaagcacugaaggggaugccaauccguuaccagacaaccgcuguuaagucugagcauacuggacgggagauugucgaucuuaugugccacgccacauuuaccaugagacugcucagccccgugagggugccuaacuauaauaugaucauaauggacgaagcucauuucacggauccggcauccauugccgcccgcggcuacaucucaacucgagucgguaugggggaggcugcggcaaucuuuaugacagccacaccaccaggaucuguagaggcuuucccucagagcaacgccgugauucaggacgaggaaagagauauccccgagcggaguuggaacuccggcuaugacuggauaaccgauuuuccaggcaaaacuguuugguucgugccuagcauuaagucugggaacgacaucgcaaauuguuugaggaaaaacggaaagcgcgucauucaacugucacguaaaacauucgauaccgaguaccagaagacaaagaacaaugacugggacuaugugguuacuacggauaucuccgaaaugggugccaacuuuagagcugaccgggugauagaucccaggcgcugccucaaaccagucauucugaaggacggcccggagcgagugauccuugcggggccuaugcccguaaccguggccagugcagcucagagacggggaaggaucggccgcaaucagaacaaagaaggugaucaauacauuuacauggggcagccacuaaauaacgacgaggaucacgcccauuggacagaggcaaagaugcuguuggacaauaucaacacucccgaaggcauuauaccugccuuauucgagccagaaagagagaaaagcgcugccaucgauggagaauauaggcugcggggcgaggcgcguaagaccuuuguugagcucaugcgccgaggggaccugcccgucuggcuuucguacaagguggcaucugaaggauuccaguauuccgauagaagguggugcuuugacggugagcggaauaaccaggugcuggaagagaauauggaugucgaaauuuggacaaaagagggcgagcgcaagaaacucagaccuaggugguuggacgcccggaccuacagcgacccgcuggcucuacgagaguucaaggaguuugccgcugggagacgcucaguuaguggagaucugauccucgaaaucggcaaacuuccacaacaccugacuuuaagggcacagaacgccuuggacaaucuggugaugcuccacaacucugagcagggugggaaggcuuaucggcaugccauggaagaacugcccgauacgauugagacccuuaugcugcucgcauugauagcgguacugacaggcggagugacuuuauucuuucuauccggcaaagggcugggaaagaccagcaucggucuccuuugugucacagccucaagugcucuguuguggauggccagcguggaaccucacuggauugcagcuuccaucauucuggaguucuuucucaugguucugcuuauccccgaaccagaccgucagagaaccccucaagauaaucagcucgccuacguggucauaggccuguuguucaugauccugacuguagcagccaacgagaugggguuacuagagacaacgaagaaagaccugggaauuggcuauguggcugcggaaaaccaucagcacgccaccaugcucgauguugaccuucaccccgcaucugcuuggacucuguacgccguggccacaaccgucaucaccccaaugaugaggcauacaauugagaauacuacggcaaacaucagcuugaccgcuauagccaaucaagcggcuauucugaugggucucgauaagggguggccuaucuccaaaauggacauuggcgugccgcugcuugccuuaggaugcuacucacaggucaacccccugacacucacugcagccguguugaugcugguugcucacuaugcaaucauaggcccagggcuacaggccaaggcgacccgcgaagcucagaaacggacagccgcaggaaucaugaagaauccuaccguggauggcauuguagccaucgaccuggaucccguggucuacgacgcuaaguuugagaaacaacucggucagauuaugcuucugaucuuguguacuucucagauacugcucaugcgaacgacaugggcccugugcgaaaguauuaccuuagcaacugggccacuuaccacacugugggagggaucgccuggcaaguucuggaacacuaccaucgcuguuagcauggccaauaucuucagagguuccuaucucgcgggcgccgggcuagcauuuucucugaugaaaucauugggaggcgggaggcgcggaacaggcgcucagggugagacgcugggggaaaaguggaaacggcaacucaaccagcuuagcaaguccgaguucaauaccuacaagagaaguggaauuauggaaguggaccguucugaggccaaagaaggccugaagaggggugagacuacaaaacaugcagucagccggggcaccgcuaaguugcgcugguuuguggagcgaaaccugguaaaacccgaagggaaggugaucgaucucggauguggcagagggggauggucauauuacugcgccggcuuaaagaaaguuacugaggugaaggguuauacaaaagggggaccgggccacgaagaaccaauaccuauggccaccuacggcuggaaucuggucaaacuucauuccgggaaagacguguucuuuaugcccccagaaaagugugauacgcugcuaugcgacauuggagagaguagccccaacccuaccaucgaggaagguaggacacuccggguccugaaaaugguggagccgugguugcgcggcaaucaguucuguauuaagauccugaaccccuacaugccaucuguuguagaaacucucgagcagaugcaaagaaagcacgggggaaugcuugugaggaauccucugucccgaaacucaacccacgagauguauugggucagcugcggcacagguaauauagugucggcgguuaacaugacuucucggauguuacugaaccguuuuaccauggcucauagaaaacccacauacgaacgcgauguggacuugggggcaggaaccaggcacgucgccguggagccugaaguagcuaaucucgauaucauuggccagcggaucgagaacauuaagaaugaacauaaaaguacuuggcacuaugacgaggauaacccauacaagacgugggccuaucacggcuccuacgaggugaaacccagcgggucagcauccucuaugguuaauggagucgugagacugcuaacaaagccuugggacgugaucccaauggucacccagauugccaugacugauaccacacccuucggucaacagcgcguuuuuaaggaaaaaguggacacgaggaccccgcgagcuaagcggggcacuacacagaucauggagguaaccgcgaaauggcuuuggggguuccugagcagaaacaagaaaccuaggauauguacucgcgaagaguuuacacguaaggugcggaguaaugccgcaauuggagcugucuucguggacgaaaaccaguggaacuccgccaaggaggcaguugaggaugaaagauuuugggaccucgugcauagggagcgcgaacugcacaaacaaggcaagugcgcaaccugcgucuauaacaugauggguaaacgagagaagaaauugggggaguucggaaaggcuaagggcagccgggccaucugguacauguggcugggcgcgagauuccucgaguuugaggcacuuggguucaugaaugaagaucauugguuuucuagggagaacucacugaguggaguggaaggugagggcuuacacaaacugggguacaucuugcgcgacauuuccaagauaccaggaggcaauauguaugccgaugacacagcugguugggauacuagaaucaccgaggacgaucuccagaacgaagccaaaauuacggacaucauggagcccgaacaugcacugcuagcuaccagcauuuucaaacuuacauaccagaauaaaguaguucgggugcagaggccugccaagaacgggacugucauggaugugaucucucgucgagaccaacgcggaucgggccaggugggcaccuaugggcugaacacauuuacuaauauggagguccagcucauaagacagauggaaucagagggaaucuuccugccaagcgaguuggaaacccccaacuuagcugagcgggcccuggauuggcucgaaaaacacggugcagagaggcuuaagcgcauggcgauuuccggcgacgacuguguugugaagccgaucgaugacagauuugccacggcucugacagcccuaaaugauauggggaaaguacggaaggacauuccucaaugggaacccaguaaaggauggaacgauuggcaacaggugccauucugcucucaccauuuucaccagcugaucaugaaggacggcagggagauagucgugccuugucgaaaucaagaugagcucguuggucgugcaagagugagccagggggcuggaugguccuugcgcgaaaccgccugccugggcaaaucauacgcacagauguggcaacuuauguauuuccaucggagggaccugagacucgccgcgaacgcuauuuguagugccguccccguggauuggguaccagcaucucgcacuacauggagcauccacgcccaccaucaguggaugaccacugaggacauguuauccguuuggaaucggguguggaucgaagagaaccccuggauggaagauaagacccacgucucaagcugggaggaggugccuuaccugggcaagagggaagaccaguggugcgggucuuugauuggacugacagcucgagccacgugggcaaccaauauacagguugcuaucaaccaagugagacggcucauugguaaugagaacuaucuugacuacaugacuuccaugaaaagguuuaagaaugaaagugauccagagggcgcccugugguga

SEQ ID NO: 13192 - RNA, 9879 nt, Artificial Sequence
  derived and/or modified CDS sequence (opt3) from DENV-1__JX669464__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgugaaugggauccucgcccagggaaagaaaaugauucggccucaacccauggagcauaaguauuccuggaagucuuggggcaaagcaaagaucauaggggcugauauccagaacacuaccuuuauuaucgacggaccagauacaccugaaugucccgacgaucagcgcgccuggaauauuugggaggucgaggacuacggcuucgguaucuuuacuaccaacauauggcugaaacuaagagauucgcacacacagaugugcgaccacaggcugaugagcgcggccauuaaggauuccaaagcugugcaugcagacaugggguauuggaucgaaucagagaagaaugaaacguggaagcucgcccgugcuaguuucauugagguuaaaaccuguaucuggccaaagucucacacucuguggagcaacggagugcuugaauccgagaugguaauacccaaaaucuacggcgguccuauuucacaacauaauuaucggccaggcuacuucacacagaccgccgggccguggcacuugggaaagcuggaguuagauuuugaccucugcgaaggcacuacagucgugguggaugagcacugcggguaccgaggacccagccugagaaccacgacugucaccggcaaaaucauucaugaaugguguugcaggucuuguacacuuccuccacugcgcuuccggggugaggacgggugcugguauggaauggagaucagacccguuaaggaaaaggaggaaaacuuggugagguccaugguaagugcaggcagcggugagauggacucuuuuucccucggcauacugugugugucaauucuaaucgaagaggucaugcgcagucgauggagccggaaaaugcugaugaccgggacucucgcgguguuccugcuuuugaucaugggacagcugacauggaaugauuuaauucgucucugcaucaugguuggcgccaacgcuucggacagaauggggaugggaaccacauaccuggcccuuauggcaacuuuuaagaugaggccuauguucgcugugggccugcuauuucgccggcucaccuccagagagguccuguugcugacgguggguuuaucucucguugccagcguggaacugccaaauucacuugaggaacugggggauggauuggcaaugggcauuaugaugcucaaacugcuaacagacuuccaaccccaccagcuguggaccacucuucucagucugaccuuuauaaggacauccuugucucuggauuaugccuggaagacuauggcuauggcguuaagcaucgucucccucuucccgcugugucuuucaaccacgagccagaaaacaaccuggcugccuguauugcucggcaguuuugggugcaagccacugacuauguuccuaauuacagagaacaagaucuggggacgaaaaucuuggcccauuaacgaagguaucauggccgugggcauaguuuccauccugcuuagcucgcuccugaagaaugacgugccuuuggcagggcccuuaauugcuggaggcaugcugaucgccuguuacgucauuucagguucuagugccgaucucucccuggagaaagcugcagaggugagcugggaagaggaagccgagcauucugggaccagccacaacauccuuguagaagugcaggacgauggaacuaugaagauaaaagacgaggagcgcgaugacacacugaccauuuugcuaaaggcgacgcugcucgcugucuccggcguuuauccaaugucaaucccugccacucuguuugugugguacuucuggcaaaaaaagaagcagcggaguggcgugcuuugggauacccccagcccaccggaagucgagagagcaguguuagacgacgggaucuauaggauucugcagcguggacucuugggucgcucucagguuggcguagggguguuccaagauggagucuuucauacaauguggcacgugacccggggcgccguucugauguaccaggguaaaagacucgaaccuuccugggcuucagugaagaaagaccugauaaguuacgggggaggcuggagguuccagggcagcuggaauacaggggaggagguccaggugaucgcaguagaacccggaaagaacccaaaaaauguccaaacuacccccgguacguuuaagauuccugagggcgaagugggggccaucgcgcuugauuucaagccaggaacauccggcucucccauuguuaaccgagaggguaaaaucguggggcuguauggaaauggcgucgugacuaccucgggcacauacguuagcgcuauagcccaggcaaaggccacccaggaagggccuuugccggagaucgaggacgaaguguuuaaaaagcggaaccuaacuauuauggaucugcacccaggaucagguaaaacccgcagauaucuccccgcuaucgucagggaggccauuaagcggaaguuacgaacacugauccuugcaccuacgagagugguagcuuccgaaauggccgaggcgcugaaaggcaugccaauacgcuaccaaacuaccgccgugaagagugaacauacagggagggagauuguugaccucaugugccacgcaaccuucacuaugcguuugcugucucccguccgggugccuaauuauaacaugaucaucauggaugaggcucauuuuacagacccggccagcauugcugcaagaggauacaucuccaccagggugggcaugggugaagccgccgcuauauucaugacggcgacucccccagggucagucgaggcauuuccucagucuaaugccguaauucaggaugaagagcgcgacauccccgaacgaagcuggaacaguggauaugauuggauuacagacuucccaggcaaaaccgugugguuuguuccuuccaucaagagcggcaaugacauagcuaacugucucagaaaaaaugggaagcgggugauucagcugucuaggaagaccuucgauacugaguaccaaaaaacaaagaacaacgacugggauuacgucgugaccacagacaucucagagaugggagccaauuuccgcgcagaucguguuaucgaccccagacggugccuuaaaccagugauucuaaaggaagguccggagagggucauccuggccggcccuaugcccgugacuguagcuuccgcggcccagcgccgagggagaauuggacggaaccagaauaaagaaggcgaucaguauauauacaugggucaaccauugaacaaugacgaggaucacgcacauuggacggaggcuaagauguuacuggacaacaucaauacccccgaagggauuaucccugcccucuuugagccagaaagggagaagagugcagccaucgauggcgaauaucgccugagaggagaggcuaggaaaacauucguggagcuuaugcggcguggcgaccugcccguuuggcucagcuacaaggucgccucggaaggguuucaguauucugaucgccgauggugcuucgacggagagagaaacaaucagguguuggaagagaacauggacguggaaauuuggacuaaagagggugagaggaagaaacugcggccucgcuggcuagaugcgagaaccuacuccgacccgcuggcacucagggaauuuaaggaguucgccgcuggccggcgaagcgucucaggggaucuuauacuggaaaucggaaaauuaccacagcacuugacacugagagcccaaaaugcucucgacaaccugguuaugcuucacaauagugagcagggcgguaaggcauaucgccaugccauggaagagcugcccgauaccauugagacucucauguugcuggcuuuaaucgccgugcuaacggggggcguaacccuguuuuuccucucuggaaagggccuugggaaaacauccauuggacuguugugugugauggcaagcucagcgcugcucuggauggccagugucgaaccucacuggaucgcugccagcauaauccuggaguuuuuccuuauggugcuccugauucccgaaccagacaggcagcggacuccucaggauaaccaauuggcauacguugugaucggucuguuauuuaugauucuaaccgucgcugccaaugagaugggccugcucgagacaaccaagaaagaccuugggaucggacauguagcaguggaaaaccaccaccaugccacuaugcuggauguugacuugcgucccgcuuccgcguggacacuguacgccguggcaacgaccgucauaacuccaaugaugagacacacaauugagaacaccaccgcuaauaucucucucacagccauugccaaccaggcagcuauccugaugggccuugauaaggguuggccuauaagcaaaauggacaucggggugccguuacuggcccucggcugcuauucccaggucaaucccuugacucugacggcggcugugcuaaugcugguugcccauuacgcaauuaucggaccaggccuccaagccaaggcuaccagggaagcacagaagcgcacagccgcggggauuaugaaaaacccuacuguggauggaaucguaaccauagaccuugaccccguggucuaugaugcuaaguucgagaaacagcugggccagauuauguugcugauccucuguacaucacaaauccuguuaaugcggaccacuugggcccuuugcgaaucuauuacgcuggcaacagguccacucaccacucuaugggaggggaguccuggaaaguuuuggaauaccacaaucgccguuucgauggcuaacauauuccgaggcagcuaccuggccggugcaggcuuggcuuucucccugaugaaaucucucgggggaggcagaagggggacuggagcccagggcgagacccuuggugaaaaguggaagcgccagcugaaucaguugucaaaaagcgaguuuaacacauauaagaaauccgggauuauggaaguggaccggagugaggcgaaggaaggacugaaaagaggcgagacgaccaagcacgccgucucucgugguacugcaaagcucaggugguucguggagcggaauuuaguaaaacccgaaggcaaggugaucgaucugggguguggacgcggcggguggagcuacuauugcgcuggacuuaaaaagguuacagaggugaaaggcuacaccaagggugggccgggacaugaagagccaauuccuauggccacuuacggcuggaaccuggucaaacuacacucaggcaaggacguguuuuucacacccccagaaaagugugauacccuccugugcgacaucggggaguccagucccaauccuacgauagaggaaggacgaaccuugagaguccugaaaaugguggagccguggcucagggguaaccaauuuuguaucaagauucuuaaucccuauaugccaagcguuguagaaacacuggagcagaugcagcggaaacacggcgggauguuagugcgcaacccucugucuagaaauuccacucaugagauguacugggucucaugcggaaccggcaacaucgugagcgcaguuaauaugacaucgaggauguugcucaaccgauucacuauggcucaccggaagcccaccuaugaacgugauguggaccugggugccgggacaagacaugucgccguggagccugaaguagcgaaccuagauauuaucggacagcgcauugagaauaucaaaaacgaacacaagucuaccuggcacuacgacgaggauaauccauauaagacuugggcuuaccauggcaguuaugaggugaaacccuccggcagcgcaucauccaugguuaacggggucgugaggcuucugacgaagccuugggacgugauaccaauggucacacaaauugccaugaccgacacuacccccuuuggacagcagcggguuuucaaagaaaagguggauacaagaacgccgcgcgcuaaaagggguaccgcccaaaucauggagguaacugcaaaguggcucuggggcuuucugucucgaaauaagaaaccucggaucuguacaagagaagaguucaccaggaaggugcgcagcaacgccgcuauuggggcggucuuuguggacgaaaaucaguggaacagugccaaagaggcaguugaggaugaacguuucugggacuuggugcaccgggagagagaacugcauaagcagggaaaaugcgcuacuugcgucuacaauaugaugggcaagagggagaagaaacucggugaauuugggaaggccaaaggaucccgcgcaauaugguacauguggcuuggcgcccgauuccuggaguucgaggcuuuaggcuuuaugaacgaagaucacugguucagccgggagaauucucugucagggguggaaggagaggguuugcauaagcucggcuauauccugagagacauuaguaaaaucccagggggaaacauguacgccgaugacacagcgggcugggauaccaggauuacagaggacgaucuacagaaugaagcaaagaucacugacauaauggagcccgaacacgcccuucuggcuaccuccaucuuuaaacucacguaucaaaacaagguaguucgcgugcagagaccugccaagagcgguaccgucauggaugugauuucucggagggaccagcgugggucgggacaggugggcacauacggccugaauacuuucaccaacauggagguccaauugauccgacagauggaaucagaggggauuuuuuuaccaagcgagcuggaaacacccaaccucgcaaaaaagguucuugacuggcuggagaaacacggagcugaacgccuaaagagaauggccaucuccggugaugacugugugguaaaaccgauagaugaccgguucgcuacugcccugaccgcacucaaugauaugggcaaggugaggaaggacauuccucagugggagcccaguaaaggguggaacgauuggcagcaagucccauuuugcucucaucacuuccaucaguugaucaugaaggacggacgcgaaaucgugguuccuuguagaaaucaggaugagcuggugggccgggcgagggucagccagggugccggguggucccuucgagagacggcuugccugggaaaaucauaugcccaaauguggcagcucauguacuuucaccguagagacuuacgccuggcagcuaacgccauuuguagugcagugcccguagauuggguuccaacaucucggaccacuuggagcauacacgcccaucaccaguggaugacaaccgaagacauguuguccguguggaauagggucuggaucgaggaaaaccccuggauggaggacaagacucaugugucaagcugggaagagguuccuuaucugggcaaaagagaggaucaauggugcggcucucucauugggcuuaccgcgcgcgcuacaugggccacgaauauccagguggcaauuaaccagguccggaggcugaucggaaaugaaaacuaccuagacuacaugaccuccaugaagcgauucaagaaugagagugauccagaaggugcccugugguga

SEQ ID NO: 13193 - RNA, 9879 nt, Artificial Sequence
  derived and/or modified CDS sequence (opt3) from DENV-1__JX669465__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgugaaugggauccucgcccagggaaagaaaaugauucggccucaacccauggagcauaaguauuccuggaagucuuggggcaaagcaaagaucauaggggcugauacucagaacaccacauuuaucauugacggaccagauacuccugaaugucccgacgaucagcgcgccuggaauaucugggaggucgaggacuacggcuucgguauuuuuaccacaaacaucuggcugaaacuaagagauucgcacacgcagaugugcgaccacaggcugaugagcgcggccauaaaggauuccaaagcugugcaugcagacaugggguauuggauugaaucagagaagaaugaaaccuggaagcucgcccgugcuaguuucaucgagguuaaaacuuguauuuggccaaagucucacacacuguggagcaacggagugcuugaauccgagaugguaauccccaaaaccuacggcgguccuauaucacaacauaauuaucggccaggcuacuucacucagacagccgggccguggcacuugggaaagcuggaguuagauuuugaccucugcgaaggcaccacggucgugguggaugagcacugcggguaccgaggacccagccugagaacuaccacagucaccggcaaaaucauucaugaaugguguugcaggucuuguacucuuccuccacugcgcuuccggggugaggacgggugcugguauggaauggagaucagacccguuaaggaaaaggaggaaaacuuggugagguccaugguaagugcaggcagcggugagauggacucuuuuucccucggcauucugugugugucaauccuaauagaagaggucaugcgcagucgauggagccggaaaaugcugaugacagggacccucgcgguguuccugcuuuugauuaugggacagcugacauggaaugauuuaauccgucucugcaucaugguuggcgccaacgcuucggacagaauggggaugggaacuaccuaccuggcccuuauggcaacguuuaagaugaggccuauguucgcugugggccugcuauuucgccggcucacauccagagagguccuguugcugaccguggguuuaucucucguugccagcguggaacugccaaauucacuugaggaacugggggauggauuggcaaugggcauuaugaugcucaaacugcuaacugacuuccaaccccaccagcuguggaccacacuucucagucugacuuuuaucaggaccuccuugucucuggauuaugccuggaagacgauggcuauggcguuaagcauugucucccucuucccgcugugucuuucaacaaccagccagaaaacuacauggcugccuguauugcucggcaguuuugggugcaagccacugaccauguuccuaauaacugagaacaagaucuggggacgaaaaucuuggcccauuaacgaagguaucauggccgugggcauuguuuccauccugcuuagcucgcuccugaagaaugacgugccuuuggcagggcccuuaauagcuggaggcaugcugaucgccuguuacgucauuucagguucuagugccgaucucucccuggagaaagcugcagaggugagcugggaagaggaagccgagcauucugggacaagccacaacauccuuguagaagugcaggacgauggaaccaugaagauuaaagacgaggagcgcgaugacacgcugacuaucuugcuaaaggcgacccugcucgcugucuccggcguuuauccaaugucaauaccugccacacuguuugugugguacuucuggcaaaaaaagaagcagcggaguggcgugcuuugggauacccccagcccaccggaagucgagagagcaguguuagacgacgggauuuauaggauccugcagcguggacucuugggucgcucucagguuggcguagggguguuccaagauggagucuuucauacaauguggcacgugacucggggcgccguucugauguaccaggguaaaagacucgaaccuuccugggcuucagugaagaaagaccugaucaguuacgggggaggcuggagguuccagggcagcuggaauaccggggaggagguccaggugauugcaguagaacccggaaagaacccaaaaaauguccaaacgacacccgguacuuuuaagaccccugagggcgaagugggggccauagcgcuugauuucaagccaggaacauccggcucucccaucguuaaccgagaggguaaaauuguggggcuguauggaaauggcgucgugaccacuucgggcaccuacguuagcgcuaucgcccaggcaaaggccacacaggaagggccuuugccggagauugaggacgaaguguuuaaaaagcggaaccuaacgaucauggaucugcacccaggaucagguaaaacucgcagauaucuccccgcuauagucagggaggccaucaagcggaaguuacgaacccugauucuugcaccuacaagagugguagcuuccgaaauggccgaggcgcugaaaggcaugccaauccgcuaccaaaccacugccgugaagagugaacauacagggagggagauuguugaccucaugugccacgcaaccuucacgaugcguuugcugucucccguccgggugccuaauuauaacaugaucauaauggaugaggcucauuuuacugacccggccagcauugcugcaagaggauacaucuccacaagggugggcaugggugaagccgccgcuaucuucaugaccgcgacccccccagggucagucgaggcauuuccucagucuaaugccguaauucaggaugaagagcgcgacauccccgaacgaagcuggaacaguggauaugauuggauaacugacuucccaggcaaaacagugugguuuguuccuuccauuaagagcggcaaugacaucgcuaacugucucagaaaaaaugggaagcgggugauucagcugucuaggaagaccuucgauacagaguaccaaaaaacuaagaacaacgacugggauuacgucgugacgaccgacaucucagagaugggagccaauuuccgcgcagaucguguuauagaccccagacggugccuuaaaccagugauucuaaaggaagguccggagagggucauccuggccggcccuaugcccgugacaguagcuuccgcggcccagcgccgagggagaaucggacggaaccagaauaaagaaggcgaucaguauauuuacaugggucaaccauugaacaaugacgaggaucacgcacauuggacugaggcuaagauguuacuggacaacaucaauacccccgaagggauuauaccugcccucuuugagccagaaagggagaagagugcagccaucgauggcgaauaucgccugagaggagaggcuaggaaaacauucguggagcuuaugcggcguggcgaccugcccguuuggcucagcuacaaggucgccucggaaggguuucaguauucugaucgccgauggugcuucgacggagagagaaacaaucagguguuggaagagaacauggacguggaaauuuggaccaaagagggugagaggaagaaacugcggccucgcuggcuagaugcgagaacuuacuccgacccgcuggcacucagggaauuuaaggaguucgccgcuggccggcgaagcgucucaggggaucuuauccuggaaaucggaaaauuaccacagcacuugacgcugagagcccaaaaugcucucgacaaccugguuaugcuucacaauagugagcagggcgguaaggcauaucgccaugccauggaagagcugcccgauaccauugagacacucauguugcuggcuuuaauagccgugcuaacugggggcguaacccuguuuuuccucucuggaaagggccuugggaaaacauccaucggacuguugugugugauggcaagcucagcgcugcucuggauggccagugucgaaccucacuggauugcugccagcaucauucuggaguuuuuccuuauggugcuccugauccccgaaccagacaggcagcggaccccucaggauaaccaauuggcauacguugugauaggucuguuauuuaugauccuaacugucgcugccaaugagaugggccugcucgagacaacgaagaaagaccuugggauuggacauguagcaguggaaaaccaccaccaugccaccaugcuggauguugacuugcgucccgcuuccgcguggacucuguacgccguggcaacaaccgucaucaccccaaugaugagacacacaauugagaacacuacggcuaauaucucucucaccgccauagccaaccaggcagcuauucugaugggccuugauaaggguuggccuaucagcaaaauggacauuggggugccguuacuggcccucggcugcuauucccaggucaaucccuugacacugacugcggcugugcuaaugcugguugcccauuacgcaaucauaggaccaggccuccaagccaaggcuaccagggaagcacagaagcgcacagccgcggggaucaugaaaaacccuaccguggauggaauuguaacuaucgaccuugaccccguggucuaugaugcuaaguucgagaaacagcugggccagauuauguugcugauccucuguacgucacaaauacuguuaaugcggacaaccugggcccuuugcgaaucuauuacucuggcaaccgguccacucacaacucuaugggaggggaguccuggaaaguuuuggaauaccacaaucgccguuucgauggcuaacaucuuccgaggcagcuaccuggccggugcaggcuuggcuuucucccugaugaaaucucucgggggaggcagaagggggacgggagcccagggcgagacccuuggugaaaaguggaagcgccagcugaaucaguugucaaaaagcgaguuuaacacuuauaagaaauccgggauuauggaaguggaccggagugaggcgaaggaaggacugaaaagaggcgagacaaccaagcacgccgucucucgugguacugcaaagcucaggugguucguggagcggaauuuaguaaaacccgaaggcaaggugaucgaucugggguguggacgcggcggguggagcuacuauugcgcuggacuuaaaaagguuacagaggugaaaggcuacaccaagggugggccgggacaugaagagccaauaccuauggccacguacggcuggaaccuggucaaacuacacucaggcaaggacguguuuuucacccccccagaaaagugugauacacuccugugcgacauuggggaguccagucccaauccuacuaucgaggaaggacgaaccuugagaguccugaaaaugguggagccguggcucagggguaaccaauuuuguauuaagauccuuaaucccuauaugccaagcguuguagaaacacuggagcagaugcagcggaaacacggcgggauguuagugcgcaacccucugucuagaaauuccacucaugagauguacugggucucaugcggaaccggcaacauagugagcgcaguuaauaugacaucgaggauguugcucaaccgauucaccauggcucaccggaagcccacuuaugaacgugauguggaccugggugccgggacgagacaugucgccguggagccugaaguagcgaaccuagauaucauuggacagcgcaucgagaauauuaaaaacgaacacaagucuacauggcacuacgacgaggauaauccauauaagaccugggcuuaccauggcaguuaugaggugaaacccuccggcagcgcaucauccaugguuaacggggucgugaggcuucugacuaagccuugggacgugaucccaauggucacccaaauugccaugacagacacgacccccuuuggacagcagcggguuuucaaagaaaagguggauacuagaacaccgcgcgcuaaaagggguaccgcccaaaucauggagguaacugcaaaguggcucuggggcuuucugucucgaaauaagaaaccucggauauguacaagagaagaguucaccaggaaggugcgcagcaacgccgcuauuggggcggucuuuguggacgaaaaucaguggaacagugccaaagaggcaguugaggaugaacguuucugggacuuggugcaccgggagagagaacugcauaagcagggaaaaugcgcuacaugcgucuacaauaugaugggcaagagggagaagaaacucggugaauuugggaaggccaaaggaucccgcgcaaucugguacauguggcuuggcgcccgauuccuggaguucgaggcuuuaggcuuuaugaacgaagaucacugguucagccgggagaauucucugucagggguggaaggagaggguuugcauaagcucggcuauauccugagagacauuaguaaaauaccagggggaaacauguacgccgaugacacugcgggcugggauaccaggaucacggaggacgaucuacagaaugaagcaaagauuaccgacaucauggagcccgaacacgcccuucuggcuacauccauuuuuaaacucacuuaucaaaacaagguaguucgcgugcagagaccugccaagagcgguaccgucauggaugugaucucucggagggaccagcgugggucgggacaggugggcacauacggccugaauacuuucaccaacauggagguccaauugauacgacagauggaaucagaggggaucuuuagcccauccgaguuagaaacgcccaaccuggcaaaaaagguucucgacuggcuugagaaacacggagcugaacgccugaagagaauggccauuaguggugaugacugugugguaaaaccgaucgaugaccgguucgcuacagcccuaaccgcacugaaugauaugggcaagauuaggaaggacaucccucagugggagcccucuaaaggguggaacgauuggcagcaagugccauuuugcagccaucacuuccaucagcucauaaugaaggacggacgcgaaauugucgugccuuguagaaaucaggaugaguugguuggccgggcgagggugucccagggugccggguggucacugcgagagacugcuugccuuggaaaaaguuaugcccaaauguggcagcugauguacuuucaccguagagaccuccgcuuagcagcuaacgccaucuguucugcaguccccguggauuggguaccaacaagccggaccacuugguccauccacgcccaucaccaguggaugaccacagaagacaugcugucaguuuggaauaggguguggauugaggaaaaccccuggauggaggacaagacgcaugucagcucuugggaagaggugccuuauuugggcaaaagagaggaucaauggugcggcucccugauagggcucaccgcgcgcgcuacuugggccacaaauauccagguugcaauuaaccaggugcggaggcuuaucggaaaugaaaacuaccuggacuacaugaccaguaugaagcgauucaagaaugagagcgauccagaaggugcccuaugguga

SEQ ID NO: 13194 - RNA, 9879 nt, Artificial Sequence
  derived and/or modified CDS sequence (opt3) from DENV-1__JX669466__SS-prME
agcgugaccaugcugcucaugcuucugcccaccgccuuggcuuuccacuuaacuacgagaggaggggaaccucauaugaucguauccaagcaggaaaggggaaagucucugcuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaggcagauccagcggguggagacuugggcucugcgccacccuggauucaccguuauugcauuuuuccuggcccaugcuaucggcacaucgauuacccagaaaggcaucauauuuauccucuuaaugcuggugacgccaucaauggccaugagaugcgucgggauuggaaacagggacuucguggagggucuuagcggcgcgacuuggguagauguuguguuggaacacgggaguugugucacaaccauggcaaagaauaagcccacucuggacaucgagcuacucaaaacagaagugaccaacccugccgugcugcggaaacuuugcauugaggcuaaaaucuccaauacgaccacagauucucgcuguccaacucaaggagaagccacccuggucgaggagcaggacgcaaacuuuguuugccgaagaacauucguggauaggggcugggguaauggguguggauuguuuggcaagggcagccuccugacuugcgcuaaauucaagugcguaaccaaguuagaagggaaaauagugcaguacgagaaccugaaguauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccacggacuggauuggacuuuaacgagaugguccuacugacaaugaaagaaaagagcuggcucgugcauaaacagugguuccuggaucuuccgcugcccuggacgucuggcgcauccaccucacaagaaacuuggaaucgucaggacuugcucguaacauuuaagaccgcucacgccaaaaagcaggagguugugguccuggguagccaagaaggggcuaugcacacagccuuaacuggcgcaaccgagauccagacgaguggaaccacaacuauuuucgccggccaucugaagugccgccuaaaaauggauaagcucacccugaaagggaugucuuaugugauguguacaggauccuucaaacuugaaaaagaggucgcugagacucagcacgguaccauauuggugcagguuaaguacgaaggcacggacgcgccuugcaagaucccauuuagcacacaagaugagaaaggggugacccagaacggaagacugauuacugcaaaucccaucguaacagacaaggaaaaaccugucaacauagagaccgagccacccuucggcgaaucguauauugugguuggugccggggagaaggcucucaaacugucuugguuuaagaggggcuccucaaucggaaagauguucgaagccacugcacggggcgcccgacgcauggcuauccuuggggauaccgccugggacuuuggaaguauugguggcguguucacaagcgucgggaaacuggugcaucagguauuuggaacggcauacggcguguuguucuccgguguuucuuggaccaugaagaucgggauuggcauacuccugacuugguuaggacugaauagcagaucaacaagucuauccaugaccuguaucgcggucggcauggugacacucuaccugggggugaugguccaggcugaucuuggaugcguuauuaacuggaaaggcagggaguugaagugugguagcgggaucuuugugacuaacgaagugcacaccuggacggagcaauauaaauuccaggccgacucuccgaagcggcugucagcagccaucggaaaggcuugggaggaaggcguaugcgguauucgcagugccacaagacucgagaauauaauguggaaacagaucagcaacgaacugaaucauauuuuacuggagaacgauaugaaguuuaccgucgugguuggcgacgcaaaugggauccuugcucagggcaagaagaugauuaggccucaacccauggaacacaaauacuccuggaagucuuggggcaaagccaagaucauaggggcggacauccagaacacuaccuucauuaucgauggaccagacacaccugagugucccgauggccagcgugccuggaauauuugggagguggaagacuaugguuuuggggucuucacuaccaacaucugguugaagcuccgggauucguacacacagaugugcgaccaccgacugaugagcgcugcaauaaaagauuccaaggccgugcaugcugacaugggauauuggauugagucagagaagaaugagacguggaagcuagccagagcaaguuucaucgaaguuaaaaccuguacuuggccaaagucucacacacuguggagcaacggcgugcucgaguccgagaugauuauccccaagauauuugguggcccuaucucacaacauaauuacaggccaggguauuucacccagacugcgggaccguggcaccugggcaaacuugaauuggauuuugaccugugcgaggggacaaccguagucguggaugaacacugcggaaaccgcggccccagcuuacggacgacuaccgugacagguaagauuauccaugagugguguugcagaucuuguacccucccuccacugagguuccgcggggaggacggaugcugguacggcauggaaauucgacccgucaaagagaaggaagagaaucuuguucgguccauggugagugccgguagcggcgaaguagauucuuuuucccuggggaucuugugugugucaauaaugauugaggaggucaugcguaguagauggagcaggaaaaugcucaugacuggaacacuggcuguguuccuacugcucaucaugggccagcugaccuggaacgaccuuauccgcuugugcauuaugguuggggccaaugcaucggaccggaugggaaugggcacaacuuaccuggcuuuaauggccaccuuuaagaugagaccuauguucgcagugggucuccuguuuaggcgacuuacgucccgcgaaguccugcuacucacaaucgggcugucuuugguggccagcguugagcugccaaacucauuagaggaacucggagauggccuggcuaugggcauuaugaugcuuaagcuguugaccgaguuccaaccccaccagcucuggacuacccugcuaagucugacauuugugaaaacuacccuuucccucgacuaugcguggaagacgacagccaugguccugucuauagucagcuuguucccgcuguguuuauccaccacuucacagaaaacaaccuggcucccugugcugcuugggagcuuuggaugcaagccacugacuauguucuugaucacagagaacaaaauuuggggucggaagaguuggccccucaaugagggcaucauggcaauugggaucguuucuauacugcuauccagccugcuuaagaacgaugugccucucgcuggaccccugaucgccggcgguauguugauugccuguuacgucaucucggggucaucugcugacuuaagucuggaaaaagcagccgagguguccugggaacaggaggcggaacauagcggagcuucucacaauauucucguagaggugcaagaugacggcaccaugaagaucaaagaugaggaaagagacgauacgcugacuauacuucugaaggccaccuugcuagcagucagcggcguuuauccaauguccauuccugccacacuguucgugugguacuuuuggcagaaaaagaaacagaggucaggggugcucugggacacccccaguccaccggaggucgaacgugcugugcuggaugacggaaucuaucgcauccuucagcgggguuuacugggcagaagccaaguugggguaggaguguuccaggauggcgucuuucauacaauguggcacgugacuaggggugcaguucucauguaccaggggaagcgauuggagccuucuugggccuccgugaagaaagaccugauuucauauggaggcggcuggcgguuccaggggaguuggaacaccggagaggaaguccaagugauagcgguagagcccgguaagaaucccaagaacguccagacgacacccggcacuuuuaagaccccugaaggggaggugggagcuaucgcccucgacuucaaaccaggcacaagcgguucccccauuguuaaucgcgaagggaagaucgugggacuguacggcaacggcgucgugaccacuucugggaccuacguuucggcaauugcccaggcuaaggccagccaagagggaccucuuccggagaucgaagaugagguguuuaaaaagagaaaucugacaauaauggacuugcacccagguucaggcaaaacgaggcgguaucuacccgcaaucguccgagaagcuauuaagagaaaacugcgcacucucaucuuagccccuaccagggugguagcguccgagauggccgaagcacugaaggggaugccaauucguuaccagacaaccgcugugaagagugagcauacuggacgggagaucguugaucuuaugugccacgccacauucaccaugagacugcucucucccgucagggugccuaacuauaauaugauaauuauggacgaagcucauuuuacggauccggcaagcaucgccgcccgcggcuacaucuccacucgaguggguaugggggaggcugcggcaauuuucaugacagccacaccaccaggaucagucgaggcuuuuccucagucuaacgccguaauccaggacgaggaaagagauauacccgagcggagcuggaauaguggcuaugacuggauuaccgauuucccaggcaaaacugugugguucguuccuuccaucaagagcgggaacgacauugcaaauuguuugaggaaaaacggaaagcgcgugauccaacugucucguaaaacauuugauaccgaguaccagaagacaaagaacaaugacugggacuaugucgugacuacggauauaucagaaaugggugccaacuucagagcugaccggguuauugaucccaggcgcugccucaaaccagugauccugaaggacggcccggagcgagucauccuugcggggccuaugcccgugaccguagccuccgcagcucagagacggggaaggauuggccgcaaucagaacaaagaaggugaucaauacguguacauggggcagccacuaaauaacgacgaggaucacgcccauuggacagaggcaaagaugcuguuggacaauaucaacacucccgaaggcauuauaccugccuuauuugagccagaaagagagaaaagugcugccaucgauggagaauauaggcugcggggcgaggcgcguaagaccuucguugagcucaugcgccgaggggaccugcccgucuggcuuagcuacaagguggcaucggaaggauuucaguauucugauagaagguggugcuucgacggugagcggaauaaccaggugcuggaagagaauauggaugucgaaauuuggacaaaagagggcgagcgcaagaaacucagaccuaggugguuggacgcccggaccuacuccgacccgcuggcucuacgagaauuuaaggaguucgccgcugggagacgcagcguuucaggagaucugauccucgaaaucggcaaacuuccacaacaccugacuuuaagggcacagaacgccuuggacaaucuggugaugcuccacaacagugagcagggugggaaggcuuaucggcaugccauggaagaacugcccgauacgauugagacccuuaugcugcucgcauugauagcgguacugacaggcggagugacuuuauuuuuccuaucuggcaaagggcugggaaagaccuccaucggucuccuuugugucacagccagcucagcucuguuguggauggccaguguggaaccucacuggauugcagcuagcaucauucuggaguuuuuccucaugguucugcuuauccccgaaccagaccgucagagaaccccucaagauaaucagcucgccuacguggucauaggccuguuguuuaugauccugacuguagcagccaacgagaugggguuacuagagacaacgaagaaagaccugggaauuggcuauguggcugcggaaaaccaucagcacgccaccaugcucgauguugaccuucaccccgcauccgcuuggacucuguacgccguggccacaaccgucaucaccccaaugaugaggcauacaauugagaauacuacggcaaacaucucuuugaccgcuauagccaaucaagcggcuauucugaugggucucgauaagggguggccuaucagcaaaauggacauuggcgugccgcugcuugccuuaggaugcuacucccaggucaacccccugacacucacugcagccguguugaugcugguugcucacuaugcaaucauaggcccagggcuacaggccaaggcgacccgcgaagcucagaaacggacagccgcaggaaucaugaagaauccuaccguggauggcauuguagccaucgaccuggaucccguggucuacgacgcuaaguucgagaaacaacucggucagauuaugcuucugaucuuguguacuucacagauacugcucaugcgaacgacaugggcccugugcgaaucuauuaccuuagcaacugggccacuuaccacacugugggagggaaguccuggcaaguucuggaacacuaccaucgcuguuucgauggccaauaucuuuagagguagcuaucucgcgggcgccgggcuagcauucucccugaugaaaucuuugggaggcgggaggcgcggaacaggcgcucagggugagacgcugggggaaaaguggaaacggcaacucaaccagcuuucaaagagcgaguuuaauaccuacaagagauccggaauuauggaaguggaccguagugaggccaaagaaggccugaagaggggugagacuacaaaacaugcagucucucggggcaccgcuaaguugcgcugguucguggagcgaaaccugguaaaacccgaagggaaggugaucgaucucggauguggcagagggggauggagcuauuacugcgccggcuuaaagaaaguuacugaggugaaggguuauacaaaagggggaccgggccacgaagaaccaauaccuauggccaccuacggcuggaaucuggucaaacuucauucagggaaagacguguuuuucaugcccccagaaaagugugauacgcugcuaugcgacauuggagaguccagucccaacccuaccaucgaggaagguaggacacuccggguccugaaaaugguggagccgugguugcgcggcaaucaguuuuguauuaagauccugaaccccuacaugccaagcguuguagaaacucucgagcagaugcaaagaaagcacgggggaaugcuugugaggaauccucugucucgaaacuccacccacgagauguauugggucucaugcggcacagguaauauagugagcgcgguuaacaugacuucgcggauguuacugaaccguuucaccauggcucauagaaaacccacauacgaacgcgauguggacuugggggcaggaaccaggcacgucgccguggagccugaaguagcuaaucucgauaucauuggccagcggaucgagaacauuaagaaugaacauaaaucuacuuggcacuaugacgaggauaacccauacaagacgugggccuaucacggcaguuacgaggugaaacccuccgggagcgcaucauccaugguuaauggagucgugagacugcuaacaaagccuugggacgugaucccaauggucacccagauugccaugacugauaccacacccuuuggucaacagcgcguuuucaaggaaaaaguggacacgaggaccccgcgagcuaagcggggcacuacacagaucauggagguaaccgcgaaauggcuuuggggguuucugucuagaaacaagaaaccuaggauauguacucgcgaagaguucacacguaaggugcggagcaaugccgcaauuggagcugucuuuguggacgaaaaccaguggaauagugccaaggaggcaguugaggaugaaagauucugggaccucgugcauagggagcgcgaacugcacaaacaaggcaagugcgcaaccugcgucuauaacaugauggguaaacgagagaagaaauugggggaguucggaaaggcuaagggcucccgggccaucugguacauguggcugggcgcgagauuucucgaguucgaggcacuuggguuuaugaaugaagaucauugguucagcagggagaacucucugucaggaguggaaggugagggcuuacacaaacugggguacaucuugcgcgacauuaguaagauaccaggaggcaauauguaugccgaugacacagcugguugggauacuagaaucaccgaggacgaucuccagaacgaagccaaaauuacggacaucauggagcccgaacaugcacugcuagcuaccuccauuuuuaaacuuacauaccagaauaaaguaguucgggugcagaggccugccaagaacgggacugucauggaugugaucagccgucgagaccaacgcggaucuggccaggugggcaccuaugggcugaacacauucacuaauauggagguccagcucauaagacagauggaaucggagggaaucuuucugccaucagaguuggaaacccccaacuuagcugagcgggcccuggauuggcucgaaaaacacggugcagagaggcuuaagcgcauggcgauuagcggcgacgacuguguugugaagccgaucgaugacagauucgccacggcucugacagcccuaaaugauauggggaaaguacggaaggacauuccucaaugggaacccuccaaaggauggaacgauuggcaacaggugccauuuugcagucaccauuuccaccagcugaucaugaaggacggcagggagauagucgugccuugucgaaaucaagaugagcucguuggucgugcaagagugucucagggggcuggauggagcuugcgcgaaaccgccugccugggcaaauccuacgcacagauguggcaacuuauguauuuucaucggagggaccugagacucgccgcgaacgcuauuuguucagccguccccguggauuggguaccagcaagucgcacuacauggucuauccacgcccaccaucaguggaugaccacugaggacauguuaagcguuuggaaucggguguggaucgaagagaaccccuggauggaagauaagacccacgucuccucaugggaggaggugccuuaccugggcaagagggaagaccaguggugcgggagcuugauuggacugacagcucgagccacgugggcaaccaauauacagguugcuaucaaccaagugagacggcucauugguaaugagaacuaucuugacuacaugacuucuaugaaaagguucaagaaugaauccgauccagagggcgcccugugguga

SEQ ID NO: 13195 - RNA, 9879 nt, Artificial Sequence
  derived and/or modified CDS sequence (opt3) from DENV-1__JX669467__SS-prME
agcgugaccaugcugcucaugcuucugccaacagcauuggcuuuccacuuaacuacgagaggaggggagccucauaugaucgucuccaagcaagaaaggggaaaaucucugcuguuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauuuucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggacgagcuugggaggagggcgucugcgguaucaggagcgccacccggcucgaaaauauuauguggaaacagauauccaacgagcugaaucauaucuuacuggaaaacgacauuaaguucacugugguugugggcaaugcaaacgggauccuugcucagggcaaaaagaugauucgcccucaacccauggagcacaaauacucuuggaagucguggggcaaggccaaaaucauaggggcggacauccagaauaccacauuuauuaucgauggaccagacacuccugaaugucccgaugagcagagagccuggaacauuugggaggucgaagacuauggcuucgguaucuuuaccacaaauauaugguugaagcucagggauagcuacacgcagaugugcgaccaccgucugauguccgcugcaauuaaagauucaaaggccgugcaugcugacaugggguauuggaucgagagugagaaaaacgagaccuggaagcuagcccgggcaucuuucauugaaguuaagacuuguaucuggccaaaaagccacacacugugguccaauggagugcucgagucagagaugauaauccccaagauguacggcgguccuauuagccaacauaacuaucgaccaggcuacuucacccagacugcggggccguggcaccugggaaaacuugaauuggauuuugaccugugcgagggcacaaccguagucguggaugaacacugcgggucuagaggacccuccuuaaggacgacuaccgugacaggcaagaucauucaugagugguguugccgcaguuguacccucccuccacugcgguucagaggugaggacgggugcugguacggaauggaaaucaggcccgucaaagagaaggaagagaaucuuguucgcagcauggugucugccggcuccggugaaguagauucauuuagucugggcauauugugugugagcauuaugaucgaggaggucaugcgaucgcgguggucccguaagaugcucaugacugggacacuggcuguguuccuacugcucaucaugggacagcugaccuggaacgaccuuauuagauugugcaucaugguuggcgccaaugcaucugacaaaauggggaugggaacaacuuaucuggcuuuaauggccaccuuuaagaugaggccuauguucgcagugggccuccuguuucgccggcuuacgagcagagaaguccugcuacucacaauuggucugucauugguggccaguguugagcugccaaacuccuuagaggaacucggggauggacuggcuaugggcauaaugaugcuuaaacuguugaccgaguuccaaccccaccagcucuggacuacccugcuaucucugacauuuaucaagacuacccuuagccucgacuacgcguggaaaacgacagccaccgugcuguccauugucucauuguucccgcuguguuuaagcacuacaagucagaagaccacuuggcucccuguacugcuuggcucuuuugggugcaagccacugacaauguucuugaucaccgagaacgagauuuggggaaggaaauccuggccccucaaugaagguaucauggcaauaggcaucgugagcauucugcuaucgucacugcuuaagaacgauguuccucucgcugggccccugaucgccggaggcauguugauugccuguuaugugaucucugguaguuccgcugacuuaagccuggagaaagcagccgaagucucuugggaggaagaggcggagcauagcgggacgucccacaauauacucguggaaguacaggaugacggaacuaugaagauuaaagaugaggaacgagacgauacccugacaauccuucugaaggcuaccuugcuagccgugucaggcgucuacccaaugaguaucccugcaacacuguuuguuugguauuucuggcagaaaaagaagcagcgcagcggcgugcucugggacacucccucuccaccggagguggagcgggccguccuggaugacgggauuuacagaauacuucagaggggauuacugggucguucccaggugggcguugggguauuccaagauggaguguuucauaccauguggcacgucacgcgcggcgcugugcucauguaucaggguaaacgguuggaaccuucaugggcaaguguuaagaaagaccugaucagcuacgggggaggcuggagauuccagggcuccuggaacacaggggaggaagugcaggucauugccguggagcccggaaagaaucccaaaaacguacaaacuacccccgguacauuuaagaccccugaaggcgaggucggggcgaucgcucucgacuucaagccaggaacuucuggcucgcccauugugaauagggaggguaaaaucguugggcuguacggaaacggcguggucaccacaagcggcacguaugugucagccauagcacaggccaaggcuucccaggaagggccucuuccggagaucgaagaugagguuuuuaaaaagcgaaaucugacuauuauggacuugcacccaggaagugguaaaacccggcgcuaccuacccgccaucgugagagaagcaauuaagaggaagcugcggacacucaucuuagcuccuacccgagucguggccucugagauggcggaggcccugaaaggcaugccaauaagauaucaaacuacagcaguaaagagcgaacauaccgggcgcgagauuguggaucuuaugugccacgcuacguucacuaugaggcugcucucccccguucgugucccuaacuacaauaugaucaucauggacgaagcccauuuuacagauccggcuucaauugcagcccggggauauaucucuaccagagugggcaugggugaggccgcugcgauauucaugaccgcaacucccccagggagcguggaagccuuuccucagaguaacgcugucauucaggacgaggagagggauauccccgaacgcuccuggaauagcggauacgacuggauuacagauuucccaggcaaaaccguaugguuugugccuucuaucaagucaggcaacgacauagccaauuguuugcggaaaaacgggaagagaguuauucagcuguccagaaagacauucgauacugaguaucagaaaacgaagaacaaugacugggacuacguggucaccacagauaucagugaaaugggagcaaacuucagggccgaccgcgugaucgauccccguagaugccucaaaccaguuauucugaaggacgguccggagcgggugauccuugcuggcccuaugcccgucacuguggcgagcgccgcacagaggcgcgggcgaauuggaagaaaucagaacaaagagggcgaucaguacguauauaugggucaaccacuaaauaacgacgaagaucacgcucauuggaccgaggccaagaugcuguuggacaauauaaacacacccgaagggaucauuccugcauuauuugagccagaacgggagaagucggccgcuaucgauggcgaguacaggcugcgcggagaagccagaaaaaccuucguggagcucaugaggcggggcgaccugcccguuuggcuuucuuauaaggucgcguccgaaggguuucaguacagcgaucgucgcuggugcuucgacggagagcgaaauaaccaggugcuggaagagaauauggauguggagaucuggacuaaagaaggugagagaaagaaacucaggccucggugguuggacgcacgcacguauucagacccgcuggcccuaagagaauuuaaggaguucgcugccggcaggcggagugucucuggggaucugauucucgaaauaggaaaacuuccacagcaccugaccuuacgagcucaaaacgcauuggacaaucugguuaugcuccacaacuccgagcagggcgguaaggccuacagacaugcuauggaggaacugcccgauacaaucgagacucuuaugcugcucgccuugauugcagugcugaccgggggcguaacauuauuuuuccuaagcggaaagggccuggggaaaaccucaaucggacuccuuugugugacugcgaguagcgcccuguuguggauggcuuccgucgaaccucacuggauugccgcaucuaucauacuggaguuuuuccucauggugcugcuuauccccgagccagaccgccagaggacaccucaggauaaucaacucgcuuauguugugauuggucuguuguuuaugauccugacggucgccgcaaacgaaaugggcuuacuagagaccacuaagaaagaccuggggauuggacauguagccgcugaaaaccaccagcacgcgacaaugcucgauguggaccuucaucccgccagcgcauggacccuguacgcuguugccaccacagugaucacuccaaugaugcggcacacgauagagaauaccacagccaacauuuccuugacugcaaucgcuaaucaggccgcgauucugaugggccucgauaaggguuggccuaucucaaaaauggaccugggggucccgcuuuuagcucugggcugcuacucucaagugaacccccucaccuugacagccgcaguccugaugcuaguggcccauuaugcuauaaucggaccaggccugcaggcaaaggccacccgugaagcgcagaagagaacugcugccgggauuaugaaaaauccuacgguugauggaaucguggcaauugaccucgaucccguaguguacgacgccaaguucgagaaacagcuuggccaaaucaugcuguugauacuguguacaagucagauucuccugaugaggaccacuugggcuuuaugcgagucgaucacccuugccacagguccacugacuacccucugggaagggagcccuggaaaguuuuggaacacaacgaucgcagucuccauggcuaauauuuuccgcggcucuuaucuagccggugcgggccuggccuucucauugaugaaaagccuagggggaggccggcgagggaccggagcacagggcgagacucucggugaaaaguggaagagacagcuuaaccaacuguccaaaagugaguuuaauacauacaagaggucugggaucauggaaguugaccgcagcgaggcuaaagagggauugaagcggggcgaaaccacuaaacacgccgugucaagagguacagcaaagcugcguugguucgucgagaggaaccucgugaagcccgaaggcaaaguaauagauuuaggguguggacggggcgggugguccuauuacugcgcuggacugaagaaagugaccgagguuaagggcuauacgaaaggugggccgggacaugaagaaccaauuccuauggccaccuacggcuggaaucuugugaagcugcacaguggcaaagacgucuuuuucaugcccccagagaagugugauacacuacucugcgacaucggggaaagcucucccaacccuacuauugaggaaggacgcacccugcgaguguugaagauggucgagccguggcugagagguaaucaguuuuguaucaaaauacucaaccccuacaugccauccgugguugagacacuugaacagaugcagaggaagcacggcgggaugcugguacggaauccuuuaucacgcaacagcacucaugagauguauugggugucgugcggaaccggcaauaucgucucugccgugaacaugacaaguagaaugcuguugaacagguucaccauggcgcaccgaaaacccacuuacgaacgggauguugaccucggugcugggacgcgucauguggcagucgagccugaaguggccaaucuggauauuaucggacaaagaauugagaacaucaagaaugagcacaaauccacauggcacuaugacgaagauaacccauacaagaccugggcuuaucauggcagcuacgagguaaagcccucaggcuccgccucuagcauggugaaugggguuguccgccuacuuacuaaaccuugggacgugauuccaauggugacccagaucgcaaugacagauacgacccccuuuggacagcaaagggucuucaaggaaaaaguugacacucggacaccgagagccaagcgcgguaccgcucagauaauggaggugacugcgaaauggcuguggggcuuucucaguaggaacaagaagccucgaauuuguacacgggaagaguucaccagaaaaguaagguccaaugccgcaaucggggcuguguuugucgacgagaaccaguggaauagcgccaaggaagcaguggaggaugaacgcuucugggaccugguucaccgugagcgggaauugcauaaacagggaaagugcgccacaugcguguauaacaugaugggcaaaagagagaagaagcugggugaguuugggaaagcuaagggaucuagggccaucugguacauguggcucggcgcgcgcuuccuugaguucgaggcacugggcuuuaugaaugaagaucacugguucucacgagagaacaguuuauccggggucgagggagaaggucugcauaaauugggcuacauucuccgggacauaagcaagaucccagggggaaauauguaugccgaugacacugcuggcugggauaccagaauuacggaggacgaucugcaaaacgaagccaaaaucaccgacauuauggagcccgaacacgcacuacuugcuacaucuaucuuuaagcugacuuaccagaauaaagugguaaggguucagcgcccugccaagaacgguaccgugauggaugucauaucgagacgggaccagagggggucaggacaagugggcacauauggccucaacacuuucaccaauauggaggugcagcugauccgucagauggagagcgaagggauauuuuucccauccgaguuggaaagucccaacuuagcugagcgaguccuggauuggcucgaaaagcacggagccgagcgccuuaaaagaauggcaaucucuggugacgacuguguugugaagccgauugaugaccgguuugcgacggcccugaucgcucuaaaugauaugggcaaaguaaggaaggacauaccucagugggagcccagcaaaggguggaacgauuggcaacaggugccauucugcucccaucacuuucaucagcugauuaugaaggacggacgcgaaaucgucgugccuuguagaaaucaggaugagcucguuggccgggccagggugucacaaggugcaggguggaguuugcgagaaacagcuugccugggaaagucuuacgcccagauguggcagcuuauguauuuccaccguagagaccugcgccucgcagccaacgcgaucuguagcgcuguccccguggauuggguaccaaccucccggacuacauggucaauucacgcccaucaccaauggaugaccacugaggacauguuaagcguuuggaauaggguguggauagaagagaaccccuggauggaggauaaaacccaugucucuuccugggaagaggugccuuaccugggcaagagagaagaccaguggugcggcaguuugaucgggcugacagcacgcgccacgugggcuaccaauauucagguugccaucaaccaggugcggaggcucauuggaaaugagaacuaucuugacuacaugacuagcaugaaacgauuuaagaaugagucggauccagaaggugcacugugguga

SEQ ID NO: 13196 - RNA, 9879 nt, Artificial Sequence
  derived and/or modified CDS sequence (opt3) from DENV-1__HM469967__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaacaugugcacacuaauugccauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaagaagaugauccgcccucaacccauggaguacaaauauucguggaaaagcuggggcaaggcgaagauaaucggggccgacgugcagaauacuaccuuuauuaucgauggaccaaacacaccugaaugucccgacgaucagagagcuuggaauauuugggaggucgaggacuacggcuucgguaucuuuacuaccaacauauggcuuaaguugagggauuccuauacacaggugugcgaccaccgucucaugucagcagccauuaaagauaguaaggcuguucacgccgacaugggguacuggaucgaaucugagaaaaaugaaacguggaagcuggcacgggcgagcuucauugaggugaagaccuguaucuggccaaaaucccauacucuauggucaaacggaguacuggaaagcgagaugauaauccccaagauuuauggcgguccuaucucucaacacaauuaccgaccaggcuacuucacacagaccgccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucuggugaaguccaugguaucugcuggcuccggugagguggacucauuuagucuuggccuguuguguauuagcaucaugaucgaagaggucaugcgcucgcgauggucccggaaaaugcucaugaccgggacucuggccguguucuuucuacugauuaugggacagcucacauggaacgaucugauccgucuuugcauuaugguuggcgcaaaugcuucugacagaauggggaugggaaccacauacuuggcccugauggcaacuuucaagaugaggccuauguuugccgugggcuuacucuuccgccggcugaccagcagagagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaagaccacauuuucccugcacuaugcauggaaaacuauggcuauggugcuuucaauugucagccucuucccccuguguuugaguaccacgucucagaagacaaccuggcugccgguauuacucggcucccuggggugcaagccucuuacuauguuucugaucgccgagaauaaaauauggggaagaaagagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgagacgauacccucacuauccugcuuaaagcuacacuguuggcagucaguggcguuuauccccuaagcauuccagccacccuguucgugugguacuucuggcaaaagaagaaacagcgcucuggcgugcucugggacacgccuucacccccaaaggucgaacgggcggugcuggaugacgggauauauagaaucaugcagaggggacuuuuaggucguagccagguuggcguagggguguuucaagagaacgucuuccauacuauguggcacgugacccgcggagcuguucugauguaccagggcaaacggcucgaaccgaguugggccagcgugaagaaagacuugauuuccuacggugggggauggagacugcagggcucuuggaauacaggcgaggagguccaggugaucgcaguagaaccugggaagaaccccaagaauguccaaaccgccccaggaacauuuaaaacucccgagggugaaauuggcgcuaucgcccucgauuucaagccugggaccucgggaagcccaauagugaacagggagggcaaaaucguuggucuguaugggaauggaguggucacgacaucaggcacuuacguguccgcaauugcucaggccaaggcgagucaggaaggcccccuuccugagaucgaggacgaaguuuuucgaaaacggaaccugaccauuauggauuugcacccggggucuggaaagacacgcagauaucuaccagccaucgugagggaggcaauaaagcggaaacugcgaacccucauuuuagcucccacuagagucguggccagcgaaauggcugaggcacugaaggguaugccuauccgcuaccaaaccacagccguaaaauccgaacauacgggcaaggagaucguggaccuuaugugccacgccacuuucaccaugaggcugcucucaccaguucguguccccaauuauaacaugauuaucauggaugaggcucauuuuacagacccuucuagcauagcggcacggggguacauuaguaccagagugggaaugggcgaagccgcugccaucuucaugacugcaacaccgcccgguuccguggaggccuuuccacagagcaaugcugucauucaggaugaagagagggacaucccugaacgcucuuggaacucaggguaugaguggauaaccgauuuccccggaaaaacgguaugguuugugccauccauuaaggcgggcaaugacaucgccaacuguuugcgaaagaauggcaaaagaguuauccagcugagucggaagacuuucgauacagaguaccagaaaaccaagaacagcgacugggacuacguggucaccacugauauuucggaaaugggggcaaacuucagggcugaccgcgugaucgauccucguagaugccucaaacccguuauucugaaggacggaccagagcgggugauacuugccgguccgaugccugucacaguggcaucugccgcucagaggcgcggccgaguagggagaaaucacaacaaggaaggagaucaguauaucuacaugggccagccccuaaauaacgacgaggaucaugcccacuggaccgaggcgaaaaugcuguuggacaauauuaacacaccagaagguaucauccccgcauuauuugagccugaacgggagaaguccgccgcuauugauggggaauauaggcugcgcggcgaggccagaaaaacuuucguggagcucaugaggcggggagaccugccaguuuggcuuagcuacaaggucgcuucagaaggcuuucaauauagugaucgucgcuggugcuucgacggggagcgaaauaaccaggugcuggaagagaauauggauguggaaauauggacgaaagagggagagagaaagaaacucaggccccggugguuggacgcacgcaccuacucugacccucuggcccuaagagaauuuaaggaguucgcugccgguaggcgguccgucagcggcgaucugauccucgaaauugggaaacuuccgcagcaccugacacagcgagcacaaaacgcguuagacaauuugguuaugcugcauaacucagagcagggaggcagagccuaucgccacgcuauggaagaacucccagauacuaucgagacccugaugcuucuggcccucauugcaguguugacaggugggguaacccuguuuuucuuaaguggcaggggacuaggcaaaacuagcaucgggcugcucugugugauggcuuccucuguccuucuguggauggccagcguggaaccccauuggauagcagccuccaucauuuuggaguuuuuccugaugguucuccugaucccugaacccgaccggcagcguacgccacaggauaaucaacuugcuuacguggucauuggacuccuguuuaugaucuugaccguagcggccaacgagaugggucuguuagagacaacuaagaaagaccuaggcauagggcacguggcaguugaaaaucaccaucacgcugccaugcuggauguggaccuccauccugccucagcauggacccuuuacgcugucgccacaaccauuaucacucccaugaugagacacacaauugagaacacgaccgcgaacaucucucugacugcuauagccaaucaggcagccaucuugaugggacuggauaagggcuggccaauuaguaaaauggacaucggugugccucuccuggcucuugggugcuauucgcaggucaacccguuaacacugaccgcagccgugcucauguugguugcgcauuacgcuauuaucggccccggacugcaagccaaggcaaccagggaagcccagaagcgcacagcugccggcauaaugaaaaauccaacuguggaugggauuguagcaaucgaccuagauccuguggucuaugacgcuaaguucgagaaacagcugggacagaucaugcuccuuauucuguguacgagccaaaucuugcugaugcggaccacaugggcccucugcgaauccauaacucuggcgaccggccccuuaacaacccuuuggaaggguucuccagggaaauuuuggaacacuacgauugccguuucaauggcaaauaucuuccgaggaagcuaccuggcuggcgccggucucgcauucucccuaaugaagagucugggcgggggaagaaggggcacaggggcucagggagagaccuugggcgagaaguggaaacgccagcugaaccagcucucuaagagcgaauuuaauacuuauaaacggucagguauuauggagguggacagauccgaagccaaggaggggcuuaaacguggagaaaccacaaagcacgccgucaguaggggcacugcgaagcugaaaugguucguggagcggaacuugguaaagccugaggguaaagugaucgaucugggcugugggcgcggaggcuggagcuacuauugcgcugggcucaagaaaguuaccgaagugaagggauacacaaaaggcggucccgggcacgaggaaccgauaccaauggcaacguacggauggaauuuagucaagcugcauucuggcaaggacguguuuuucaucccucccgagaaaugugauacccuucugugcgacauuggcgaauccucaccaaaccccacuaucgaggaggggcgaacacuaagaguccucaagaugguggaaccuuggcugaggaaaaaucaauuuuguauuaagaucuugaacccguauaugcccagcguuguagagacccuggaacagaugcagcggaaacacggagguaugcucgugcgcaauccacuuucgagaaacucuacucaugagauguacugggucaguugcggcacagggaauauuguguccgccguuaacaugaccagcaggaugcuguuaaaucgauucacgauggcucaccggaagccuaccuaugagcgugauguggaccugggagccggcacaagacacgucgcaguggaacccgagguagccaacuuggauaucauaggucagcgcauugaaaacaucaagcaugagcacaaaucaacuuggcauuacgacgaagauaauccuuauaagaccugggcuuaccacggguccuaugaggugaaaccaucuggaagcgcgaguuccaugguuaacggcgucgugaagcuccugacaaaacccugggacgugaucccuauggucacucaaauugccaugaccgauacaaccccauuuggccagcagaggguuuucaaggagaagguggacacucggacgcccaaagcaaagagagggacagcucaaauaauggaaguaaccgcccgcuggcuauggggauuucuuagcaggaauaaaaagccgcgaaucuguacucgggaggaguucaccagaaaagugaggucuaacgcagccauuggugcugucuuuguggacgagaaucaguggaacucagccaaggaagcgguugaggaugagcgcuucugggaccuggugcaucgugaacgggagcuccacaagcagggcaaaugcgcaacaugcgucuacaauaugauggggaagagagagaaaaagcugggagaguuuggcaaagccaaggguaguagggcuaucugguacaugugguugggggcccgcuuccuggaguucgaggcacucggauuuaugaacgaggaucacugguucucccgagaaaauagccuuucuggcguggagggcgaagggcugcauaaauuaggauauauucugcgggacaucucgaagauaccugguggcaacauguacgcugaugacacggccgggugggauaccagaaucacugaggacgauuugcagaaugaggcuaagauuacagacaucauggaaccagagcacgcccuccuggcaaaaucaauuuuuaagcuaaccuaucaaaacaaaguaguuagggugcagcgccccgcgaagaauggaacugucauggaugugaucagcagacgggaccagaggggcuccggucagguggggacauacggacuuaacaccuucacaaauauggaagcccaacugauacgucagauggagagugaaggcauauuuucuccuagcgagcucgagacuccaaaccuggcugaacgagucuuggauugguuagagaaauauggcguugaacgccugaagagaauggccaucuccggggacgacugugugguaaagcccaucgaugaccgguucgcaaccgcucucacggcccuuaacgauaugggaaaagugaggaaggacauuccgcagugggagccuucaaaagguuggaaugauuggcagaagguccccuuuugcagucaucacuuccaccaacugauaaugaaagacggccgcgaaaucgugguuccauguagaaaccaggaugagcuaguggggcgggcaagggucucucagggagccggcuggagccugcgagagaccgcgugccucgguaaguccuacgcucagauguggcaauugauguauuuucaucguagagaccugcgccuugccgcaaaugccauuuguucagcugugccuguagauuggguucccacaagccggacuaccuggucuauccacgcccaucaccaguggaugacaacugaagacaugcuguccguguggaacagggucuggauugaggaaaauccauggauggaggauaagacccauaucaguagcugggaagacgugcccuaccucgggaaaagagaggaccaguggugcggaucguuaauaggccugacggcacgcgcuacaugggccaccaacauccaaguugcgauuaaucaggugcggagguugaucggcaacgagaauuaccuggauuauaugacuuccaugaagcgauucaaaaacgaaucugacccugagggggcucucugguga

SEQ ID NO: 13197 - RNA, 9879 nt, Artificial Sequence
  derived and/or modified CDS sequence (opt3) from DENV-1__JX669468__SS-prME
agcgugaccaugcugcucaugcuucugccaacugcauuggcuuuccacuuaacuacgagaggaggggagccucauaugaucgucuccaagcaagaaaggggaaaaucucugcuguuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauuuucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaggaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguaacgggauuuucgugaccaaugagguacacacguggacagaacaauauaaauuucaggccgauucuccgaagcgccugucagcagccaucggacgagcuugggaggagggcgucugcgguaucaggagugccacccggcucgaaaacauuauguggaaacagauaagcaaugagcugaaccauaucuuacuggaaaaugacauuaaguucacugugguugugggcaacgcaaaugggauccuugcucagggcaaaaagaugauucgcccucaacccauggagcacaaauacuccuggaagucuuggggcaaggccaaaaucauaggggcggacauccagaacaccacauuuauuaucgauggaccagacacuccugaaugucccgaugagcagagagccuggaauauuugggaggucgaagacuauggcuucgguaucuuuaccacaaacauaugguugaagcucagggauucguacacgcagaugugcgaccaccgucugaugagcgcugcaauuaaagauuccaaggccgugcaugcugacaugggguauuggaucgagucagagaaaaaugagaccuggaagcuagcccgggcaaguuucauugaaguuaagacuuguaucuggccaaaaucucacacacuguggagcaacggagugcucgaguccgagaugauaauccccaagauguacggcgguccuauuucacaacauaauuaucgaccaggcuacuucacccagacugcggggccguggcaccugggaaaacuugaauuggauuuugaccugugcgagggcacaaccguagucguggaugaacacugcgggagcagaggacccucuuuaaggacgacuaccgugacaggcaagaucauucaugagugguguugccgcuccuguacccucccuccacugcgguucagaggugaggacgggugcugguacggaauggaaaucaggcccgucaaagagaaggaagagaaccuuguucgcaguauggugagcgccggcucuggugaaguagauuccuuuucacugggcauauugugugugaguauuaugaucgaggaggucaugcgaagccgguggucgcguaagaugcucaugacugggacacuggcuguguuccuacugcucaucaugggacagcugaccuggaaugaccuuauuagauugugcaucaugguuggcgccaacgcauccgacaaaauggggaugggaacaacuuaucuggcuuuaauggccaccuuuaagaugaggccuauguucgcagugggccuccuguuucgccggcuuacgucuagagaaguccugcuacucacaauuggucugagcuugguggccucaguugagcugccaaacaguuuagaggaacucggggauggacuggcuaugggcauaaugaugcuuaaacuguugaccgaguuccaaccccaccagcucuggacuacccugcuaucccugacauuuaucaagacuacccuuucucucgacuacgcguggaaaacgacagccaccgugcugagcauugucuccuuguucccgcuguguuuaucaacuacaagccagaagaccacuuggcucccuguacugcuuggcaguuuugggugcaagccacugacaauguucuugaucaccgagaaugagauuuggggaaggaaaucuuggccccucaacgaagguaucauggcaauaggcaucguguccauucugcuaagcucgcugcuuaagaaugauguuccucucgcugggccccugaucgccggaggcauguugauugccuguuaugugaucucagguucuagugcugacuuaucccuggagaaagcagccgaagucagcugggaggaagaggcggagcauucugggacgagccacaacauacucguggaaguacaggaugacggaacuaugaagauuaaagaugaggaacgagacgauacccugacaauccuucugaaggcuaccuugcuagccguguccggcgucuacccaaugucaaucccugcaacacuguuuguuugguauuucuggcagaaaaagaagcagcgcaguggcgugcucugggacacucccagcccaccggagguggagcgggccguccuggaugacgggauuuacagaauacuucagaggggauuacugggucguucucaggugggcguugggguauuccaagauggaguguuucauaccauguggcacgucacgcgcggcgcugugcucauguaucaggguaaacgguuggaaccuuccugggcaucaguuaagaaagaccugaucaguuacgggggaggcuggagauuccagggcagcuggaauacaggggaggaagugcaggucauugccguggagcccggaaagaaccccaaaaauguacaaacuacccccgguacauuuaagaccccugaaggcgaggucggggcgaucgcucucgacuucaagccaggaacuuccggcucucccauugugaacagggaggguaaaaucguugggcuguacggaaauggcguggucaccacaucgggcacguaugugagcgccauagcacaggccaaggcuucacaggaagggccucuuccggagaucgaagaugagguuuuuaaaaagcgaaaccugacuauuauggacuugcacccaggauccgguaaaacccggcgcuaccuacccgccaucgugagagaagcaauuaagaggaagcugcggacacucaucuuagcuccuacccgagucguggccagugagauggcggaggcccugaaaggcaugccaauaagauaucaaacuacagcaguaaagucugaacauaccgggcgcgagauuguggaucuuaugugccacgcuacguucacuaugaggcugcucagccccguucgugucccuaauuacaacaugaucaucauggacgaagcccauuuuacagauccggcuuccauugcagcccggggauauaucucaaccagagugggcaugggugaggccgcugcgauauucaugaccgcaacucccccagggucuguggaagccuuuccucagagcaaugcugucauucaggacgaggagagggauauccccgaacgcaguuggaacuccggauacgacuggauuacagauuucccaggcaaaaccguaugguuugugccuagcaucaagucuggcaaugacauagccaacuguuugcggaaaaacgggaagagaguuauucagcugucaagaaagacauucgauacugaguaucagaaaacgaagaauaacgacugggacuacguggucaccacagauaucuccgaaaugggagcaaauuucagggccgaccgcgugaucgauccccguagaugccucaaaccaguuauucugaaggacgguccggagcgggugauccuugcuggcccuaugcccgucacuguggcgagugccgcacagaggcgcgggcgaauuggaagaaaccagaauaaagagggcgaucaguacguauauaugggucaaccacuaaacaaugacgaagaucacgcucauuggaccgaggccaagaugcuguuggacaacauaaauacacccgaagggaucauuccugcauuauuugagccagaacgggaaaagagcgccgcuaucgauggcgaguacaggcugcgcggagaagccagaaaaaccuucguggagcucaugaggcggggcgaccugcccguuuggcuuucguauaaggucgcgucugaaggguuucaguacuccgaucgucgcuggugcuucgacggagagcgaaacaaucaggugcuggaagagaacauggauguggagaucuggacuaaagaaggugagagaaagaaacucaggccucggugguuggacgcacgcacguauagcgacccgcuggcccuaagagaauuuaaggaguucgcugccggcaggcggucagucaguggggaucugauucucgaaauaggaaaacuuccacagcaccugaccuuacgagcucaaaaugcauuggacaaccugguuaugcuccacaauucugagcagggcgguaaggccuacagacaugcuauggaggaacugcccgauacaaucgagacucuuaugcugcucgccuugauugcagugcugaccgggggcguaacauuauuuuuccuauccggaaagggccuggggaaaaccagcaucggacuccuuugugugacugcgucaagugcccuguuguggauggcuagcgucgaaccucacuggauugccgcauccaucauacuggaguuuuuccucauggugcugcuuauccccgagccagaccgccagaggacaccucaggauaaccaacucgcuuauguugugauuggucuguuguuuaugauccugacggucgccgcaaacgaaaugggcuuacuagagaccacuaagaaagaccuggggauuggacauguagccgcugaaaaucaccagcacgcgacaaugcucgauguggaccuucaucccgccucugcauggacccuguacgcuguugccaccacagugaucacuccaaugaugcggcacacgauagagaacaccacagccaauauuagcuugacugcaaucgcuaaccaggccgcgauucugaugggccucgauaaggguuggccuaucuccaaaauggaccugggggucccgcuuuuagcucugggcugcuacucacaagugaauccccucaccuugacagccgcaguccugaugcuaguggcccauuaugcuauaaucggaccaggccugcaggcaaaggccacccgugaagcgcagaagagaacugcugccgggauuaugaaaaacccuacgguugauggaaucguggcaauugaccucgaucccguaguguacgacgccaaguucgagaaacagcuuggccaaaucaugcuguugauacuguguacaucucagauucuccugaugaggaccacuugggcuuuaugcgagaguaucacccuugccacagguccacugacuacccucugggaagggucgccuggaaaguuuuggaauacaacgaucgcagucagcauggcuaacauuuuccgcggcuccuaucuagccggugcgggccuggccuucucuuugaugaaaucacuagggggaggccggcgagggaccggagcacagggcgagacucucggugaaaaguggaagagacagcuuaaucaacugagcaaauccgaguuuaacacauacaagaggagugggaucauggaaguugaccgcucugaggcuaaagagggauugaagcggggcgaaaccacuaaacacgccgugagcagagguacagcaaagcugcguugguucgucgagaggaaucucgugaagcccgaaggcaaaguaauagauuuaggguguggacggggcggguggucauauuacugcgcuggacugaagaaagugaccgagguuaagggcuauacgaaaggugggccgggacaugaggaaccaauuccuauggccaccuacggcuggaaccuugugaagcugcacuccggcaaagacgucuuuuucaugcccccagagaagugugauacacuacucugcgacaucggggaaaguagccccaauccuacuauugaggaaggacgcacccugcgaguguugaagauggucgagccguggcugagagguaaccaguuuuguaucaaaauacucaaucccuacaugccaucugugguugagacacuugaacagaugcagaggaagcacggcgggaugcugguacggaacccuuuaucccgcaauucaacucaugagauguauugggugagcugcggaaccggcaacaucgucucggccgugaacaugacaucuagaaugcuguugaauagguucaccauggcgcaccgaaaacccacuuacgaacgggauguugaccucggugcugggacgcgucauguggcagucgagccugaaguggccaaccuggauauuaucggacaaagaauugagaauaucaagaacgagcacaaaaguacauggcacuaugacgaagauaauccauacaagaccugggcuuaucauggcuccuacgagguaaagcccagcggcucagccuccucuauggugaacgggguuguccgccuacuuacuaaaccuugggacgugauuccaauggugacccagaucgcaaugacagauacgacccccuuuggacagcaaagggucuucaaggaaaaaguugacacucggacaccgagagccaagcgcgguaccgcucagauaauggaggugacugcgaaauggcuguggggcuuucucagcaggaauaagaagccucgaauuuguacacgggaagaguucaccagaaaaguaaggaguaacgccgcaaucggggcuguguuugucgacgagaaucaguggaacuccgccaaggaagcaguggaggaugaacgcuucugggaccugguucaccgugagcgggaauugcauaaacagggaaagugcgccacaugcguguauaauaugaugggcaaaagagagaagaagcugggugaguuugggaaagcuaagggaagcagggccaucugguacauguggcucggcgcgcgcuuccuugaguucgaggcacugggcuuuaugaacgaagaucacugguucucucgagaaaauucauuaaguggggucgagggagaaggucugcauaaauugggcuacauucuccgggacauauccaagaucccagggggaaacauguaugccgaugacacugcuggcugggauaccagaauuacggaggacgaucugcaaaaugaagccaaaaucaccgacauuauggagcccgaacacgcacuacuugcuacaagcaucuuuaagcugacuuaccagaacaaagugguaaggguucagcgcccugccaagaacgguaccgugauggaugucauaucuagacgggaccagagggggucgggacaagugggcacauauggccucaauacuuucaccaacauggaggugcagcugauccgucagauggagucagaagggauauuuuucccaagcgaguuggaaucccccaauuuagcugagcgaguccuggauuggcucgaaaagcacggagccgagcgccuuaaaagaauggcaaucaguggugacgacuguguugugaagccgauugaugaccgguuugcgacggcccugaucgcucuaaacgauaugggcaaaguaaggaaggacauaccucagugggagcccucuaaaggguggaaugauuggcaacaggugccauucugcagccaucacuuucaucagcugauuaugaaggacggacgcgaaaucgucgugccuuguagaaaccaggaugagcucguuggccgggccagggugucccaaggugcaggguggucauugcgagaaacagcuugccugggaaagaguuacgcccagauguggcagcuuauguauuuccaccguagagaccugcgccucgcagccaaugcgaucuguucugcuguccccguggauuggguaccaaccagccggacuacaugguccauucacgcccaucaccaauggaugaccacugaggacauguuaucaguuuggaacaggguguggauagaagagaaucccuggauggaggauaaaacccaugucagcucuugggaagaggugccuuaccugggcaagagagaagaccaguggugcggcuccuugaucgggcugacagcacgcgccacgugggcuaccaacauucagguugccaucaaucaggugcggaggcucauuggaaacgagaauuaucuugacuacaugacaaguaugaaacgauuuaagaacgagagcgauccagaaggugcacugugguga

SEQ ID NO: 13198 - RNA, 9879 nt, Artificial Sequence
  derived and/or modified CDS sequence (opt3) from DENV-1__JX669469__SS-prME
agcgugaccaugcugcucaugcuucugcccacugcauuggcuuuccacuuaacuacgagaggaggggaaccucauaugaucgucuccaagcaggaaagaggaaaaucucugcuauuuaagaccucagccgguguuaacaugugcacacucauugcaauggaccugggcgaacuuugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauuaaagcuaagaucuccaauacgaccacagacucuagguguccaacucaaggagaagccaccuuggucgaggaacaggaugcaaacuucguuugccggcgcacauuuguggaccgaggcugggguaauggguguggacucuucggcaagggcagccuguuaacuugcgcuaaauuuaagugcguaaccaaacuggaggggaagauagugcaguacgagaaccucaaauauuccgucauugugacaguucacaccggagaucagcaucaaguggguaaugaaacuacggagcacggcacaaucgccaccauuacuccccaggcgccuaccucagaaauccagcuuacagacuacggggcccugaccuuggacuguaguccaagaacuggacuagauuucaacgagaugguccugcucacaaugaaggaaaagagcuggcuggugcauaagcagugguuucuugaccugccguugcccuggacgucuggcgcauccaccucacaagagacuuggaauaggcaggaucuccugguaacauucaagaccgcucacgccaaaaagcaggagguuguggucuuagguagccaagagggggcuaugcacacagcccugacuggcgcaaccgagauccagacgaguggaaccacaacuauuuuugccggccaucuaaaaugccggcucaagauggacaaacugacccuuaaggggacaucuuaugugauguguacuggauccuucaaguuggaaaaagaggucgcugaaacccagcacgguacggugcugguucaggugaaguacgagggcacagaugcgccuugcaaaauaccauucagcacccaagacgagaaggggguaacucagaacggacgucucaucacagcaaaucccauugucaccgauaaagaaaagccugugaacaucgagacugaaccacccuuuggcgagucguauauaguugugggugccggggagaaggcucugaaacuuucuugguucaagaaaggcuccucaauuggaaagauguuugaagccaccgcacgcggcgccagaaggauggcuauccugggggacacagccugggauuucggaaguaucgguggcgucuuuacgagcguggggaaauugguacaucagguguucggaaccgcauacggcguucucuuuuccggugucucuuggacuaugaagauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaguugaaaugugguucugggauuuucgugaccaacgaaguacacacguggacagagcaauauaaguuucaggccgauucaccgaaacgccugagugcagccaucggcagagcuugggaagagggcgucugcgguaucaggagcgccacccggcucgagaauauuauguggaagcagauauccaacgaacugaaucauaucuuacuggagaacgacauuaaauucacugugguugugggcaaugcaaacgggauccuugcucagggaaagaaaaugauucgcccucaacccauggaacacaaguacucuuggaagucguggggcaaagccaagaucauaggggcggacauccagaauaccacauuuauuaucgauggaccagacacuccugagugucccgaugaacagagagccuggaacauuugggaggucgaggacuauggcuucgguaucuuuaccacaaauauaugguugaaacucagggauagcuacacgcagaugugcgaccaccgucugauguccgcugcaauuaaggauucaaaagccgugcaugcugacaugggguauuggaucgaaagugagaagaacgaaaccuggaagcuagcccgggcaucuuucauugagguuaaaacuuguaucuggccaaagagccacacacugugguccaauggagugcucgaaucagagaugauaauccccaaaauguacggcgguccuauuagccaacauaacuaucgaccaggcuacuucacccagacugcggggccguggcaccugggaaaacuugaguuggauuuugaccugugcgaaggcacaaccguagucguggaugagcacugcgggucuagaggacccuccuuaaggacgacuaccgugacaggcaaaaucauucaugaaugguguugccgcaguuguacccucccuccacugcgguucagaggugaggacgggugcugguacggaauggagaucaggcccgucaaggaaaaggaggaaaaucuuguucgcagcauggugucugccggcuccggugagguagauucauuuagucugggcauauugugugugagcauuaugaucgaagaggucaugcgaucgcgguggucccguaaaaugcucaugacugggacacuggcuguguuccuacugcucaucauggcccagcugaccuggaacgaccuuauuagauugugcaucaugguuggagcaaaugcuucugacaagaugggcauggggacaacuuaucuggccuuaauggcaaccuuuaaaaugaggccuauguucgccgugggacuccuguuucgccggcuuacgagcagagagguccugcuacucacaauuggccugucauugguggcuaguguugaacugccaaacuccuuagaggaacucggugaugggcuggcgaugggaauaaugaugcuuaagcuguugaccgaguuccaaccccaccagcucuggacuacccugcuaucucugacauuuaucaaaacuacccuuagccucgacuacgccuggaagacgacagcaauggugcuguccauugucucauuguucccgcuguguuuaagcaccacaagucagaagacaaccuggcucccuguacugcuuggcucuuuuggcugcaaaccacugacuauguucuugaucacagaaaacgagauuugggggaggaaguccuggccccucaaugagggaaucauggcuauagguaucgugagcauucugcuaucgucacugcuuaaaaacgauguuccucucgccggcccccugaucgccgggggaauguugauugcuuguuaugugaucucuggcaguuccgcagacuuaagccuggaaaaggccgcggaggucucuugggaagaggaagcugagcauagcgguaccucccacaauauacucguggagguacaggaugacgggacgaugaaaauuaaggaugaagaacgagacgauacucugaccauccuucugaaagccacauugcuagcagugucaggagucuacccaaugaguaucccugccacccuguuuguuugguauuucuggcaaaagaagaaacagcgcagcggcgugcucugggacacacccucuccaccggaaguggagcgggcuguccuggaugacggcauuuacagaauacuucagaggggguuacugggacguucccagguggguguuggcguauuccaagaugggguguuucauacuauguggcacgucacccgcggagcagugcucauguaucagggcaagcgguuggagccuucaugggccaguguuaaaaaggaccugaucagcuacggugggggauggagauuccagggcuccuggaacacgggcgaagaggugcaggucauugcgguggaacccgggaaaaauccaaagaacguacaaacaacucccggaaccuuuaagacaccugagggugaagucggcgcuaucgcccucgacuucaaaccagggaccucuggaucgcccauugugaauagggagggcaagaucguuggucuguacgggaacggaguggucacuaccagcggcacauaugugucagcaauagcccaggcuaaagccucccaggagggcccucuuccggaaaucgaggaugaaguuuuuaagaaacgaaaucugacgauuauggacuugcacccagggaguggaaagacucggcgcuaccuacccgcaaucgugagagaggcuauuaagaggaaacugcggacccucaucuuagccccuacacgagucguggcgucugaaauggccgaggcacugaaggguaugccaauaagauaucaaaccacugcuguaaaaagcgagcauacaggccgcgaaauuguggaucuuaugugccacgccaccuucacgaugaggcugcucucccccguucgugucccuaacuacaauaugaucaucauggacgaggcucauuuuacugauccggcaucaauugccgcccggggguauaucucuacaagagugggaaugggcgaagcugcggcaauauucaugaccgccacacccccagguagcguggaggcuuuuccucagaguaacgccgucauucaggacgaagagagggauauccccgagcgcuccuggaauagcggguacgacuggauuacugauuucccaggaaagacaguaugguuugugccuucuaucaaaucaggcaacgacauagcaaauuguuugcgaaagaacggcaagagaguuauucagcugucccggaaaaccuucgauacagaauaucaaaagacuaaaaacaaugacugggacuacguggucacgaccgauaucagugagaugggggccaacuucagggcugaccgcgugaucgauccccguagaugccucaagccaguuauucugaaagacggaccggaacgggugauccuugcggguccuaugcccgucacaguggccagcgcagcucagaggcgcggccgaauugggagaaaucagaacaaggagggagaucaguacguauauaugggccaaccacuaaauaacgacgaggaucacgcccauuggacugaagcaaagaugcuguuggacaauauaaacacccccgaggguaucauuccugccuuauuugaaccagagcgggaaaaaucggcugccaucgauggggaguacaggcugcgcggcgaggcgagaaagacauucguggaacucaugaggcggggagaccugcccguuuggcuuucuuauaaagucgcauccgagggcuuucaguacagcgaucgucgcuggugcuucgacggggaacgaaauaaccaggugcuggaggaaaauauggauguggagaucuggaccaaggagggagaaaggaagaagcucaggccucggugguuggacgcccgcacuuauucagacccgcuggcucuaagagaguuuaaagaguucgccgcugguaggcggagugucucuggcgaucugauucucgagauagggaaacuuccacagcaccugacguuacgagcacaaaacgccuuggacaaucugguuaugcuccacaacuccgaacagggaggcaaggcuuacagacaugccauggaggagcugcccgauaccaucgaaacacuuaugcugcucgcauugauugcggugcugacuggugggguaaccuuauuuuuccuaagcggcaaaggacugggcaagacaucaaucgggcuccuuugugugaccgccaguagcgcucuguuguggauggccuccgucgagccucacuggauugcagcuucuaucauacuggaauuuuuccucauggugcugcuuauccccgagccagaccgccagaggacuccucaggauaaucaacucgccuauguugugauuggacuguuguuuaugauccugacagucgcagccaacgagauggguuuacuagaaacgaccaaaaaggaccugggcauugggcauguagcugcggagaaccaccagcacgccacuauccucgauguggaccuucaucccgcaagcgcuuggacacuguacgccguugccaccaccgugauaacaccaaugaugcggcacacuauugaaaauacgaccgcaaacaucuccuugacagcuauugccaaucaggcggcuauccugaugggacucgauaaaggcuggccuauaucaaagauggaccugggugucccgcuuuuagcccuggggugcuacucucaagugaacccccucacuuugaccgcagccguccugaugcuaguggcucauuaugcaaucauuggcccaggacugcaggccaaggcgacacgugaggcucagaaaagaaccgccgcaggcaucaugaagaauccuacuguugaugggauuguggccaucgaccucgaucccguaguguacgacgcuaaauucgaaaagcagcuuggacaaauaaugcuguugauucuguguacgagucagauccuccugaugaggacaaccugggccuuaugcgagucgaucacucuugcaaccggcccacugacaacucucugggaggguagcccugggaaauuuuggaacaccacaauugcugucuccauggccaauaucuuccgcggaucuuaucuagcgggcgccggucuggcauucucauugaugaaaagccugggcgggggacggcgaggcacgggggcucagggagaaacccucggcgagaaguggaaaagacagcuuaaccaacuguccaagagugaauuuaauacuuacaaaaggucugguauaauggagguugaccgcagcgaagccaaggagggguugaaacggggagagacaaccaagcacgcagugucaagaggcacugcuaagcugcguugguucgucgaaaggaaccucgugaaacccgaggguaagguaauugauuuaggcugugggcggggaggcugguccuauuacugcgccgggcugaaaaaggugacagaaguuaaaggauauaccaagggcgguccggggcaugaggaaccaaucccuauggccacguacggauggaaucuugugaaacugcacaguggcaaggacgucuuuuucaugcccccagagaagugugauacccuacucugcgacauuggcgagagcucucccaacccuacaaucgaagaggggcgcacucugcgaguguugaaaauggucgaaccguggcugagaggaaaucaguuuuguauaaagauccucaaccccuacaugccauccgugguugagacccuugagcagaugcagaggaaacacgguggcaugcugguacggaauccuuuaucacgcaacagcacacaugaaauguauugggugucgugcgggacuggaaauauugucucugcggugaacaugaccaguagaaugcuguugaacagguucacaauggcucaccgaaagcccaccuacgagcgggauguugaccucggcgcagguacucgucauguggccgucgaaccugagguggcuaaucuggauaucauugggcaaagaaucgaaaacauuaaaaaugagcacaaguccacguggcacuaugacgaggauaacccauacaagacaugggccuaucauggaagcuacgaaguaaaacccucaggcuccgcaucuagcauggugaauggcguuguccgccuacuuaccaagccuugggacgugaucccaauggugacucagauagccaugaccgauacaacgcccuuugggcagcaaagggucuucaaagagaagguugacacccggacuccgagagcuaaacgcggaacagcgcagauuauggaagugaccgccaaguggcugugggguuuucucaguaggaacaagaaaccucgaaucuguacucgggaggaguucacaagaaagguaagguccaaugcagcuaucggcgccguguuugucgacgagaaccaguggaauagcgcaaaagaggccguggaagaugagcgcuucugggaccugguucaccgugaacgggaguugcauaagcaggggaaaugcgcuaccugcguguauaacaugaugggaaagagagaaaagaaacugggcgaguuugguaaggccaaagggucuagggcgauuugguacauguggcucggagcacgcuuccuugaguucgaagcccugggcuuuaugaaugaggaucacugguucucacgagaaaacaguuuauccggcgucgagggggagggacugcauaaguuggguuacauacuccgggacaucagcaaaauuccaggcgggaauauguaugcugaugacacagccggaugggauacuagaaucaccgaagacgaucugcaaaacgaggcaaagauuacggacaucauggaacccgagcacgcucuacuugccaccucuauauuuaaacugacauaccagaauaaggugguaaggguucagcgcccugcuaagaacggcacugugauggaugucaucucgagacgggaccagagggguucagggcaagugggaaccuauggccucaacacauucacuaauauggaagugcagcugauucgucagauggagagcgagggcaucuuuuucccauccgaauuggagagucccaacuuagccgaacgaguccuggauuggcucgagaaacacggggcagaacgccuuaagagaauggcgauuucuggagacgacuguguugugaaaccgaucgaugaccgguuugccaccgcucugauagcccuaaaugauauggguaagguaaggaaagacauuccucagugggagcccagcaagggcuggaacgauuggcaacaggugccauucugcucccaucacuuucaucagcugaucaugaaggacgggcgcgagaucgucgugccuuguagaaaucaggaugaacucguuggacgggcaagggugucacaaggcgcugguuggaguuugcgagagacggccugccuggggaaaucuuacgcacagauguggcagcuuauguauuuccaccguagagaccugcgccucgccgcgaacgcuauuuguagcgccguccccguggauuggguaccaacaucccggaccacuuggucaauacacgcacaucaccaauggaugacaaccgaagacauguuaagcguuuggaauaggguguggaucgaggaaaaccccuggauggaggauaagacucaugucucuuccugggaggaagugccuuaccugggaaaaagagaggaccaguggugcggcaguuugauuggccugaccgcccgcgcuacaugggccacgaauauccagguugcaauuaaccaggugcggaggcucaucgggaaugaaaacuaucuugacuacaugaccagcaugaagcgauuuaaaaaugagucggauccagagggagcucugugguga

SEQ ID NO: 13199 - RNA, 9879 nt, Artificial Sequence
  derived and/or modified CDS sequence (opt3) from DENV-1__JX669470__SS-prME
agcgugaccaugcugcucaugcuucugccaacagcauuggcuuuccacuuaacuacgagaggaggggaaccucauaugaucgucuccaagcaagaaaggggaaaaucucugcuauuuaagaccucagccgguguuaacaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaggaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggaugucuuaugugauguguacaggauccuucaaguuggagaaggaagucgcugagacucagcacgguaccgugcugguucaggugaaauacgagggcacggaugcgccuugcaagauaccauucagcacacaagacgaaaaagggguaacccagaacggacgucucaucacugcaaaucccauugucacagauaaggagaaaccugugaacaucgaaaccgagccacccuuuggcgagucguauauaguugugggugccggggaaaaggcucugaaacuuucuugguucaaaaagggcuccucaauuggaaaaauguuugaggccacugcacgcggcgccagaaggauggcuauccugggggacaccgccugggauuucggaaguaucgguggcgucuuuacaagcguggggaaguugguacaucagguguucggaacggcauacggcguucucuuuuccggugucucuuggaccaugaaaauugggaucggcauucuguuaacuuggcugggacuaaauagccggucaacaagucucuccaugaccuguauaguggugggcauggucacacuguaccuugggguuauggugcaggcggacagcggaugcgugaucaacuggaagggccgagaauugaagugugguucugggauuuucguaacuaacgagguccacaccuggacggaacaauauaaauuucaggcugauucaccgaagcgccugagugccgcaaucggacgagcaugggaggagggcgugugcgguaucaggagcgcuacacggcucgaaaauauuauguggaaacagauauccaacgagcugaaucauaucuuacuggaaaacgacauuaaguucaccguuguggucggcaaugccaacgggauccuugcacagggcaaaaagaugauucgcccucaacccauggagcacaaauacucuuggaagucguggggcaaggcuaaaaucauaggggccgacauccagaauacuaccuuuauuaucgauggaccagacacaccugaaugucccgaugagcagagagcguggaacauuugggagguggaagacuauggcuucgguaucuuuacuaccaauauaugguugaagcucagggauagcuacacacagaugugcgaccaccgucugauguccgccgcuauuaaagauucaaaggcaguucaugccgacaugggguauuggaucgagagugagaaaaacgagacguggaagcuagcucgggccucuuucauugaagugaagaccuguaucuggccaaaaagccacacucugugguccaauggaguacucgagucagagaugauaauccccaagauguacggcgguccuauuagccaacauaacuaucgaccaggcuacuucacacagaccgcagggccguggcaccugggaaaacuugaauuggauuuugaccugugcgagggcacuacagucgugguggaugaacacugcgggucuagaggacccuccuuaaggaccacgacugucaccggcaagaucauucaugagugguguugccgcaguuguacacucccuccacugcgguucagaggugaggacgggugcugguacggaauggaaaucaggcccguuaaagagaaggaagagaaucuugugcgcagcaugguaucugcgggcuccggugaaguggauucauuuagucugggcauauugugugucagcauuaugaucgaggaggugaugcgaucgcgguggucccguaagaugcucaugaccgggacucuggccguuuuccuacugcucaucaugggacagcugacauggaacgaccuuauuagauugugcaucauggugggcgcuaaugccucugacaaaauggggaugggaaccacauaucuggcauuaauggcuacuuuuaagaugaggccuauguucgccgucggccuccuguuucgccggcuuaccagcagagaagugcugcuacucacgauuggucugucauugguugcaaguguggagcugccaaacuccuuagaggaacucggggauggacuggccaugggcauaaugaugcuuaaacuguugacagaguuccaaccccaccagcucuggaccacucugcuaucucugaccuuuaucaagacaacucuuagccucgacuacgcuuggaaaaccacggcgaugguccuguccauuguaucauuguucccgcuguguuuaagcacaaccagucagaagacuacauggcucccugugcugcuuggcucuuuugggugcaagccacugaccauguucuugaucacugagaacgagauuuggggaaggaaauccuggccccucaaugaagguaucauggccguuggcauagugagcauccugcuaucgucacugcuuaagaacgaugucccucucgcagggccccugauugcuggaggcauguugaucgccuguuaugugauuucugguaguuccgccgacuuaagccuggagaaagcugcagaaguaucuugggaggaagaggccgagcauagcgggacaucccacaauauccucguggaaguccaggaugacggaaccaugaagauaaaagaugaggaacgagacgauacgcugacuauucuucugaaggcgaccuugcuagcuguuucaggcguguacccaaugaguaucccugccacacuguuugugugguaucucuggcagaaaaagaagcagcgcagcggcguccugugggacacccccucuccaccggagguggagcgggcaguucuugaugacgggaucuacagaauuuuacagaggggacugcucggucguucccagguaggcgugggggucuuccaagauggaguguuccauacaauguggcacguuacucgcggcgccguguugauguaucaggguaaacggcuggaaccuucaugggcuagugucaagaaagaccucauaagcuacgggggaggcuggagauuucagggcuccuggaacaccggggaggaagugcagguaaucgcagucgagcccggaaagaaucccaaaaacgugcaaacgacacccgguacuuucaagaccccugaaggcgagguuggggccauugcgcuggacuuuaagccaggaacaucuggcucgcccaucgugaauagggaggguaaaauugucgggcuuuacggaaacggcgugguuaccacuagcggcaccuaugugucagcuaucgcccaggcaaaggccucccaggaagggccucugccggagauagaagaugaggucuucaaaaagcgaaauuugacaaucauggaccuacacccaggaagugguaaaacgcggcgcuaccugcccgcuauugugagagaagccaucaagaggaagcuccggacuuuaauucuggcaccuacccgaguaguggcuucugagauggccgaggcgcuuaaaggcaugccaaucagauaucaaacaaccgccguuaagagcgaacauacugggcgcgagauagucgaucugaugugccacgcaacauuuaccaugaggcucuugucccccgugcgugugccuaacuacaauaugauuaucauggacgaagcucauuucacggauccggccucaaucgcugcacggggauauauuucuacuagagucggcaugggugaggccgccgcuaucuuuaugacagcgacacccccagggagcguagaagcauucccucagaguaacgccgugauacaggacgaggagagggauauucccgaacgcuccuggaauagcggauacgacuggaucaccgauuuuccaggcaaaacuguuugguucgugccuucuauuaagucaggcaacgacaucgcuaauugucugcggaaaaacgggaagagagucauacagcucuccagaaagacauuugauaccgaguaucagaaaacuaagaacaaugacugggacuacgugguuacuacggauauuagugaaaugggagccaacuucagggcagaccgcgugaucgauccccguagaugccugaaaccagucauccuuaaggacgguccggagcgggugauucuagccggcccuaugcccguaaccguggcuagcgcggcccaaaggcgcgggcgaaucggaagaaaucagaacaaagagggcgaucaguacguuuauaugggucaaccacugaauaacgacgaagaucacgcacauuggacagaggcuaagauguuguuagacaauauuaacacucccgaagggauaaucccugcccuguucgagccagaacgggagaagucggcagccauugauggcgaguacaggcuccgcggagaagcuagaaaaaccuuugucgagcugaugaggcggggcgaccuucccguguggcugucuuauaagguggccuccgaaggguuccaguacagcgaucgucgcuggugcuuugacggagagcgaaauaaccagguccucgaagagaauauggauguugagaucuggacaaaagaaggugagagaaagaaauugaggccucgguggcuggacgcgcgcaccuauucagacccgcuagcacugagagaguucaaggaguuugccgcuggcaggcggagugugucuggggaucucauccuugaaauuggaaaacugccacagcacuuaacuuugcgagcccaaaacgcucuggacaaucucguaaugcugcacaacuccgagcagggcgguaaggcauacagacaugccauggaggaacuucccgauacgauagagacccugaugcucuuggcucugaucgccguguuaacagggggcgucacucuauucuuucugagcggaaagggccucgggaaaaccucaauuggacuucugugugugacagcaaguagcgcguugcuguggauggccuccguugaaccucacuggaucgcugccucuauuauccucgaguucuuucugauggugcuucucauacccgagccagaccgccagaggaccccucaggauaaucaacuggcauaugucguaaucgguuugcuguucaugauuuuaacuguggcugccaacgaaaugggccuacuggagacaacgaagaaagaccucgggaucggacauguugcagccgaaaaccaccagcacgcuaccaugcuugauguggaccugcaucccgcgagcgccuggacuuuguacgcagucgcuacaaccgugauuaccccaaugaugcggcacacaaucgagaauacuacggccaacauaucccugaccgccauugcaaaucaggcugccauccucaugggccuggauaaggguuggccuauuucaaaaauggaccuuggggucccguuacuggcgcucggcugcuacucucaagugaaccccuugacacugacugcugccguucuaaugcugguggcacauuaugccaucauaggaccaggccuccaggcuaaggcaacccgugaagcccagaagagaacagcggcugggaucaugaaaaauccuaccguagauggaauuguggccaucgaccuugaucccgucguuuacgacgcaaaguuugagaaacagcugggccaaauuauguugcugauccucuguacgagucagauacuguuaaugaggacuacaugggcccuuugcgagucgauuacccuggcuacugguccacucaccacacuaugggaagggagcccuggaaaguucuggaacacuaccaucgccguguccauggcaaauaucuuucgcggcucuuaucuggcuggugccggcuuggcguucucacugaugaaaagccucgggggaggccggcgagggacaggagcccagggcgagacgcuuggugaaaaguggaagagacagcugaaccaauuguccaaaagugaguucaauaccuacaagaggucugggauuauggaagucgaccgcagcgaggcaaaagagggacugaagcggggcgaaacuacaaaacacgcugugucaagagguaccgccaagcuccguugguuuguagagaggaacuuagugaagcccgaaggcaaaguuaucgaucugggguguggacggggcgggugguccuauuacugcgcaggacuuaagaaagugacugaggucaagggcuauacaaaaggugggccgggacaugaagaaccaauaccuauggcuaccuacggcuggaaucuggugaagcuacacaguggcaaagacgucuucuuuaugcccccagagaagugugauacgcuccugugcgacauuggggaaagcucucccaacccuaccaucgaggaaggacgcacauugcgagugcugaagaugguugagccguggcucagagguaaucaguucuguauuaaaauccuuaaccccuacaugccauccguaguggagacucuggaacagaugcagaggaagcacggcgggauguuaguccggaauccucugucacgcaacagcacccaugagauguauugggugucgugcggaacaggcaauauaguuucugccgugaacaugacaaguagaauguugcucaacagguuuaccauggcccaccgaaaacccacauacgaacgggaugucgaccugggugcggggacccgucauguggcuguagagccugaaguggcaaaucuagauaucauuggacaaagaaucgagaacauuaagaaugagcacaaauccacuuggcacuaugacgaagauaacccauacaagacgugggccuaucauggcagcuacgagguuaagcccucaggcuccgcuucuagcauggucaaugggguggugcgccuucugacaaaaccuugggacgucaucccaaugguuacccagauugccaugacugauaccacacccuucggacagcaaaggguguuuaaggaaaaaguagacacgcggaccccgagagcaaagcgcgguacugcccagaucauggaggugacagcuaaauggcucuggggcuuccugaguaggaacaagaagccucgaauauguacccgggaagaguuuacuagaaaagucagguccaaugcggccauuggggcaguguucguugacgagaaccaguggaauagcgcuaaggaagccguggaggaugaacgcuuuugggacuugguccaccgugagcgggaacugcauaaacagggaaagugcgcaacaugcguguauaacaugaugggcaaaagagagaagaagcucggugaguucgggaaagccaagggaucuagggcuaucugguacauguggcuuggcgcccgcuuucuggaguucgaggcguuaggcuucaugaaugaagaucacugguuuucacgagagaacagucuguccgggguagagggagaagguuugcauaaacucggcuacauccugcgggacauuagcaagauaccagggggaaauauguaugcagaugacaccgccggcugggauacaagaaucacugaggacgaucuaaggaacgaagcuaaaauuaccgacaucauggagcccgaacacgcccuucuggcaacgucuauuuucaagcucaccuaccaaaauaaaguugugcgcguccagagaccugcuaagaacgguacagugauggaugugaucucgcggagggaccagcgugggucaggacaggucggcacuuauggccugaacaccuuuacaaauauggagguucaauugauacgacagauggagagcgaagggaucuucuuuccauccgaguuagaaagucccaaccuggccgagcgcgugcucgauuggcuugaaaagcacggagcugagagacugaaacggauggccauuucuggugacgacuguguagugaagccgaucgaugacagguucgcaacugcgcuaauugcccugaaugauaugggcaaaguccgcaaggacaucccucagugggagcccagcaaaggguggaacgauuggcagcaagugccauuuugcucccaucacuuccaucagcucauaaugaaggacggaagagaaauuguugugccuugucggaaucaggaugaguuggucggcagggcucgagugucacagggugccggguggagucugcgugaaaccgcaugccuuggaaagucuuacgcucaaauguggcagcugauguauuuucacagacgcgaccuccgguuagccgcaaacgccaucuguagcgcgguacccguugauugggugccaacguccaggacaaccuggucaauccacgcucaucaccaguggaugacuacagaggacaugcugagcgucuggaauagaguguggauugaagagaaccccuggauggaggauaaaacccauguuucuuccugggaagaggugccuuacuugggcaagcgcgaagaccaauggugcggcagucugauagggcucacugcccgggcaaccugggccacaaauauccaggucgcuauuaaccaggugaggcgacuuaucggaaaugagaacuaucuggacuacaugacgagcaugaaaagauucaagaaugagucggauccagaaggugcccuaugguga

SEQ ID NO: 13200 - RNA, 9879 nt, Artificial Sequence
  derived and/or modified CDS sequence (opt3) from DENV-1__JX669471__SS-prME
agcgugaccaugcugcucaugcuucugccaacugcauuggcuuuccacuuaacuacgagaggaggggagccucauaugaucgucuccaagcaagaaaggggaaaaucucugcuguuuaagaccucagccgguguuaacaugugcacacucauugccauggaccugggcgagcuuugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggacgagcuugggaggagggcgucugcgguaucaggagcgccacccggcucgaaaauauuauguggaaacagauauccaacgagcugaaucauaucuuacuggaaaacgacauuaaguucacugugguugugggcaaugcaaacgggauccuugcucagggcaaaaagaugauucgcccucaacccauggagcacaaauacucuuggaagucguggggcaaggccaaaaucauaggggcggacauccagaauaccacauuuauuaucgauggaccagacacuccugaaugucccgaugagcagagagccuggaacauuugggaggucgaagacuauggcuucgguaucuuuaccacaaauauaugguugaagcucagggauagcuacacgcagaugugcgaccaccgucugauguccgcugcaauuaaagauucaaaggccgugcaugcugacaugggguauuggaucgagagugagaaaaacgagaccuggaagcuagcccgggcaucuuucauugaaguuaagacuuguaucuggccaaaaagccacacacugugguccaauggagugcucgagucagagaugauaauccccaagauguacggcgguccuauuagccaacauaacuaucgaccaggcuacuucacccagacugcggggccguggcaccugggaaaacuugaauuggauuuugaccugugcgagggcacaaccguagucguggaugaacacugcgggucuagaggacccuccuuaaggacgacuaccgugacaggcaagaucauucaugagugguguugccgcaguuguacccucccuccacugcgguucagaggugaggacgggugcugguacggaauggaaaucaggcccgucaaagagaaggaagagaaucuuguucgcagcauggugucugccggcuccggugaaguagauucauuuagucugggcauauugugugugagcauuaugaucgaggaggucaugcgaucgcgguggucccguaagaugcucaugacugggacacuggcuguguuccuacugcucaucaugggacagcugaccuggaacgaccuuauuagauugugcaucaugguuggcgccaaugcaucugacaaaauggggaugggaacaacuuaucuggcuuuaauggccacccucaagaugaggccuauguuugcagugggccugcuuuuccgccggcugacgagcagagaaguccuacuccugacaauugguuugucacugguggccaguguugaguuaccaaacucccucgaggaacugggggauggacuugcuaugggcauaaugaugcugaaauugcucaccgaauuucaaccccaccagcuguggacuacccuacugucucuuacauucaucaagacuacccucagccuggacuacgcguggaaaacgacagccaugguguuguccauugucucacuguuuccguuaugucucagcaccacaagucagaagacaaccuggcugccuguacuucugggcucuuucgggugcaagccauugacuauguuucucaucacagagaacgagauuuggggaaggaaauccuggccccugaaugaagguaucauggcaauaggcaucgugagcauucuacugucgucacuucucaagaacgauguuccucuggcugggcccuugaucgccggaggcauguuaauugccuguuaugugaucucugguaguuccgcugaccugagccucgagaaagcagccgaagucucuugggaggaagaggcggagcauagcgggaccucccacaauauacugguggaaguacaggaugacggaacgaugaagauuaaagaugaggaacgagacgauacucuuaccauccuguugaaggcuacacuacuggccgugucaggcgucuacccaaugaguaucccugcaacccucuucguuugguauuuuuggcagaaaaagaagcagcgcagcggcgugcugugggacacacccucuccaccggagguggagcgggccguccuugaugacgggauuuacagaauauuacagaggggacugcucggucguucccaggugggcguugggguauuccaagauggaguguuccauacuauguggcacgucacccgcggcgcuguguugauguaucaggguaaacggcuggaaccuucaugggcaaguguuaagaaagaccucaucagcuacgggggaggcuggagauuucagggcuccuggaacacgggggaggaagugcaggucauugccguggagcccggaaagaaucccaaaaacguacaaacaacucccgguaccuucaagacaccugaaggcgaggucggggcgaucgcucuggacuuuaagccaggaaccucuggcucgcccauugugaauagggaggguaaaaucguugggcuuuacggaaacggcguggucacuaccagcggcacauaugugucagccauagcacaggccaaggcuucccaggaagggccucugccggagaucgaagaugagguuuucaaaaagcgaaauuugacgauuauggaccuacacccaggaagugguaaaacucggcgcuaccugcccgccaucgugagagaagcaauuaagaggaagcuccggaccuuaauccuggcuccuacacgagucguggccucugagauggcggaggcccuuaaaggcaugccaauaagauaucaaaccacugcaguaaagagcgaacauacagggcgcgagauuguggaucugaugugccacgcuaccuuuacgaugaggcucuugucccccguucgugucccuaacuacaauaugaucaucauggacgaagcccauuucacugugccggcuucaauugcagcccggggauauaucucuacaagagugggcaugggugaggccgcugcgauauuuaugaccgcaacacccccagggagcgucgaagccuucccucagaguaacgcuguaauucaggaugaggagagggacauccccgaacgcuccuggaauagcggauacgauuggauuacugacuuuccaggcaaaacagugugguucguuccuucuaucaagucaggcaacgauauagccaauugucugcggaaaaacgggaagagagugauucagcucuccagaaagaccuuugacacagaguaucagaaaacuaagaacaaugauugggacuacgucgugacgaccgacaucagugaaaugggagcaaacuucagggccgaucgcguuaucgacccccguagaugccugaaaccagugauucuuaaggaugguccggagcgggucauccuagcuggcccuaugcccgugacaguagcgagcgccgcacagaggcgcgggcgaauuggaagaaaucagaacaaagagggcgaccaguacguguauaugggucaaccacugaauaacgaugaagaccacgcucauuggacugaggccaagauguuguuagauaauauaaacacccccgaagggaucauuccugcacuguucgagccagaacgggagaagucggccgcuaucgacggcgaguacaggcuccgcggagaagccagaaaaacauuuguugagcugaugaggcggggcgaucuucccgucuggcugucuuauaagguggcguccgaaggguuccaguacagcgaccgucgcuggugcuuugauggagagcgaaauaaccaggugcucgaagagaauauggacgucgagaucuggaccaaagaaggugagagaaagaaauugaggccucgguggcuggaugcacgcacuuauucagacccgcuagcccugagagaguucaaggaguuugcugccggcaggcggaguguuucuggggaccucauucuugaaauaggaaaacugccacagcacuuaacgcaacgagcucagaacgcauuggauaaucuggugaugcuccacaacuccgagcagggcgguaaggccuacagacaugcuauggaggaacugcccgacaccaucgagacacuuaugcugcucgccuugauugcaguacugacugggggcgugaccuuauucuuucuaagcggaaagggccuggggaaaacaucaaucggacuccuuugugucaccgcgaguagcgcccuguuguggauggcuuccguggaaccucacuggauugccgcaucuaucauacuggaguucuuucucaugguucugcuuauccccgagccagaucgccagaggacuccucaagacaaucagcucgcuuauguggucauuggucuguuguucaugauccugacaguagccgcaaacgaaaugggcuuacuagagacgaccaagaaagaucuggggauuggacauguggccgcugaaaaccaccagcacgcgacuaugcucgacguugaucuucaucccgccagcgcauggacacuguacgcuguggccaccaccgucaucacaccaaugaugcggcacacuauagagaauacgaccgccaacauuuccuugacagcaaucgcuaaucaagccgcgauucugaugggccucgacaaggguuggccuaucucaaaaauggaucugggggugccgcuuuuagcucugggcugcuacucucaggucaacccccucacuuugaccgccgcagugcugaugcuaguugcccauuaugcuauaaucggaccaggccugcaggcaaaggccacacgugaagcgcagaagagaaccgcugccgggauuaugaaaaauccuacuguggacggaaucguagcaauugaucucgaccccguggucuacgaugccaaguuugagaaacaacuuggccagaucaugcuguugauacuguguacgagucagauucuccugaugaggacaaccugggcuuuaugcgagucgaucacucuugccaccgguccacugacaacucucugggaagggagcccuggaaaguucuggaacaccacaaucgcaguuuccauggcuaauauuuuucgcggcucuuaucuagccggugcgggccuggccuucucauugaugaaaagccuagggggaggccggcgagggacgggagcacagggcgagacccucggugaaaaguggaagagacaacuuaaccagcuguccaaaagugaguucaauacuuacaagaggucugggaucauggaaguggaccgcagcgaggcuaaagagggauugaagcggggcgaaacaaccaaacacgccgucucaagagguacugcaaagcugcguugguuuguggagaggaaccucguaaagcccgaaggcaaagugauagacuuaggguguggacggggcgggugguccuauuacugcgcuggacugaagaaaguuacagaggugaagggcuauaccaaaggugggccgggacaugaggaaccaauuccuauggccacguacggcuggaaucuugucaagcugcacaguggcaaagauguguucuuuaugcccccagagaagugugacacccuacucugcgauaucggggaaagcucucccaacccuacaauugaggaaggacgcacucugcgagucuugaagaugguggagccguggcugagagguaaucaguucuguaucaaaauacucaaccccuacaugccauccguuguagagacccuugaacagaugcaaaggaagcacggcgggaugcuggugcggaauccuuuaucacgcaacagcacacaugagauguauugggucucgugcggaacuggcaauaucgugucugccguuaacaugaccaguagaaugcuguugaacagguuuacaauggcgcaccgaaaacccaccuacgaccgggauguggaccucggugcugggacucgucaugucgcaguggaaccugagguagccaaucuggauauuaucggacagagaauugaaaacaucaagaaugagcacaaauccacguggcacuaugacgaggauaacccauacaagacaugggcuuaucauggcagcuacgaagugaagcccucaggcuccgccucuagcaugguuaauggggucgugcgccuacuuaccaaaccuugggacgugauuccaauggucacucagaucgcaaugaccgauacaacgcccuucggacaacagaggguuuuuaaggagaaaguggacacccggacuccgagagccaagcgcgguacagcucagauaauggaaguaaccgcgaaauggcuguggggcuuccucaguaggaacaagaagccucgaauuuguacucgggaggaauuuacaagaaaagugagguccaaugccgcaaucggggcugucuucguggacgagaaccaguggaauagcgccaaggaggcaguugaagaugagcgcuuuugggaccuggugcaccgugaacgggaguugcauaaacaaggaaagugcgcaaccugcgucuauaacaugaugggcaaaagagaaaagaagcugggugaguucgggaaagcuaagggaucuagggccaucugguacauguggcucggcgcgcgcuuucuugaguucgaagcacugggcuucaugaaugaggaucacugguuuucacgagaaaacaguuuauccgggguggagggagagggucugcauaaauugggcuacauucuccgggacauaagcaagaucccagggggaaauauguaugccgaugacacagcuggcugggauacuagaauuaccgaagacgaucugcagaacgaggccaaaaucacggacauuauggaacccgagcacgcacuacuugcuaccucuaucuucaagcugacauaccagaauaaaguaguuagggugcagcgcccugccaagaacgguacugucauggaugugauaucgagacgggaccaaagggggucaggacaggugggcaccuauggccucaacacauuuacuaauauggaaguccagcugauccgucagauggagagcgaggggauuuucuuuccauccgaauuggagagucccaacuuagcugaacgaguucuggauuggcucgagaagcacggagccgaacgccuuaaaagaauggcaaucucuggugacgacugugugguaaagccgauugaugaccgguucgcgaccgcccugaucgcucuaaaugauaugggcaaagugaggaaggacauaccucaaugggagcccagcaaaggguggaacgauuggcagcaggucccauuuugcucccaucacuuccaucagcugauuaugaaggacggacgcgagaucgugguuccuuguagaaaucaagaugaacucgugggccgggccagggucucacagggugcaggguggaguuugcgagagacggcuugccugggaaagucuuacgcccagauguggcaacuuauguauuuucaccguagagaccugcgccucgcagccaacgcgaucuguagcgcugugcccguagauuggguuccaacaucccggaccacuuggucaauucacgcccaucaccaguggaugacaaccgaagacauguuaagcguguggaauagggucuggauagaggaaaaccccuggauggaggauaaaacucaugugucuuccugggaggaaguuccuuaccugggcaagagagaggaccaguggugcggcaguuugaucgggcugaccgcacgcgccacaugggcuacgaauauucagguggccaucaaccaaguccggaggcucauuggaaaugaaaacuaucuugacuacaugaccagcaugaaacgauucaagaaugagucggauccagagggugcacugugguga

SEQ ID NO: 13201 - RNA, 9879 nt, Artificial Sequence
  derived and/or modified CDS sequence (opt3) from DENV-1__JX669472__SS-prME
agcgugaccaugcugcucaugcuucugcccacagcauuggcuuuccacuuaacuacgagaggaggggaaccucauaugaucgucuccaagcaggaaaggggaaaaucucugcuguuuaagaccucagccgguguuaacaugugcacacucauugcaauggaccugggagaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggcagagcuugggaggagggcgucugcgguaucaggagcgccacccggcucgaaaauauuauguggaaacagauauccaacgagcugaaucauaucuuacuggaaaacgacaugaaguucacugugguugugggcaaugcaaacgggauucuugcucagggcaagaagaugaucaaaccucaacccauggagcacaaguacucuuggaagucguggggcaaagccaagauuaucggggcggacauacagaauaccacauuuaucauugauggaccagacacuccugaaugucccgaugagcagcgcgccuggaacaucugggaggucgaagacuauggcuucgguauuuuuaccacaaauaucugguugaaacucagagauagcuacacgcagaugugcgaccacaggcugauguccgcugcaauaaaggauucaaaagccgugcaugcugacaugggguauuggauugagagugaaaagaacgagaccuggaagcuagcccgugcaucuuucaucgaaguuaaaacuuguauuuggccaaagagccacacacugugguccaauggagugcucgagucagagaugaucauacccaaaauguacggcgguccuaucagccaacauaacuaucggccaggcuacuucacccagacugcggggccguggcaccugggaaaacuugaauuggauuuugaccugugcgagggcacaaccguagucguggaugaacacugcgggucucgaggacccuccuuaagaacgacuaccgugacaggcaaaauuauccaugagugguguugcaggaguuguacccucccuccacugcgcuuccggggugaggacgggugcugguacggaauggaaauuagacccgucaaggagaaggaagagaaucuuguuaggagcauggugucugccggcuccggugaaguagauucauuuagucugggcaucuugugugugagcauaaugauugaggaggucaugcgcucgcgauggucccggaaaaugcucaugacugggacacuggcuguguuccuacugcucaucaugggacagcugaccuggaacgaccuuauccguuugugcauuaugguuggcgccaaugcaucugacaagauggggaugggaacaacuuaucuggcuuuaauggccaccuuuaaaaugagaccuauguucgcagugggccuccuguuuaggcgccuuacgagccgggaaguccugcuacucacaaucggucugucauugguggccaguguugagcugccaaacuccuuagaggaacucggggauggacuggcuaugggcauuaugaugcuuaagcuguugaccgaguuccaaccccaccagcucuggacuacccugcuaucucugacauuuauaaaaacuacccuuagccucgacuacgcguggaagacgacagccaccgugcuguccaucgucucauuguucccgcuguguuuaagcacuacaagucagaagaccacuuggcucccuguacugcuuggcucuuuugggugcaaaccacugacaauguucuugauuaccgagaacaagaucuggggaagaaaauccuggccccucaaugaggguauuauggcaaucggcauagugagcauccugcuaucgucacugcuuaagaacgauguuccucucgcugggccccugauugccggaggcauguugaucgccuguuaugugauuucugguaguuccgcugacuuaagccuggaaaaagcagccgaggucucuugggaagaggaagcggagcauagcgggacgucccacaauauccucguggagguacaggaugacggaacuaugaagauaaaagaugaagagagggacgauacccugacaauucuucugaaggcuaccuugcuagccgugucaggcgucuacccaaugaguaucccugcaacacuguuuguuugguauuucuggcaaaagaaaaagcagcgaagcggcgugcucugggacacucccucuccaccggaaguggagcgcgccguccuggaugacgggaucuaccggauucuucagagaggauuacuggguaggucccaggugggcguugggguauuccaagauggaguguuucauaccauguggcacgucacgcguggcgcugugcucauguaucaggguaaacgcuuggagccuucaugggcaaguguuaagaaagaccugauaagcuacgggggaggcuggcgguuccagggcuccuggaacacaggggaagaggugcaggucaucgccguggaacccggaaagaauccaaagaacguacaaacuacccccgguacauuuaaaaccccugagggcgaagucggggcgauugcucucgacuucaagccaggaacuucuggcucgcccaucgugaauagagaggguaaaauuguugggcuguacggaaacggcguggucaccacaagcggcacguaugugucagccaucgcacaggccaaggcuucccaggaggggccucuuccggaaauagaggaugaaguuuuuaaaaagaggaaucugacuaucauggacuugcacccaggaagugguaagacccgacgguaccuacccgccauugugcgcgaggcaaucaaaagaaagcugaggacacucauuuuagcuccuacccgggucguggccucugaaauggcggaggcccugaaaggcaugccaauccgauaucaaacuacagcaguaaagagcgagcauaccgggagagaaauaguggaucuuaugugccacgcuacguucacuaugcgccugcucucccccguuagggucccuaacuacaauaugauuaucauggacgaggcccauuuuacagauccggcuucaaucgcagcccguggauauauuucuacccgggugggcaugggugaagccgcugcgaucuucaugaccgcaacucccccagggagcguggaggccuuuccucagaguaacgcugucauacaggacgaagagagagauauucccgagagguccuggaauagcggauacgacuggaucacagauuucccaggcaaaaccguaugguuugugccuucuauuaagucaggcaacgacaucgccaauuguuugcgcaagaacgggaaacgaguuauacagcuguccagaaagacauucgauacugaauaucagaagacgaagaacaaugacugggacuacguggucaccacagauauuagugagaugggagcaaacuuccgggccgacagggugaucgauccccgccguugccucaaaccaguuauccugaaggacgguccggaaagagugauucuugcuggcccuaugcccgucacuguggcgagcgccgcacagcggagggggcgcaucggacgaaaucagaacaaggagggcgaucaguacguauauaugggucaaccacuaaauaacgacgaggaucacgcucauuggaccgaagccaaaaugcuguuggacaauauuaacacacccgaggggauaaucccugcauuauuugaaccagagagagaaaagucggccgcuauugauggcgaguaccggcugaggggagaggcccgcaaaaccuucguggaacucaugagaaggggcgaccugcccguuuggcuuucuuauaaggucgcguccgagggguuucaguacagcgaucggcguuggugcuucgacggagaacgcaauaaccaggugcuggaggaaaauauggauguggagaucuggacuaaagagggugaacgaaagaaacucagaccuaggugguuggacgcacggacguauucagacccgcuggcccuacgcgaguuuaaggaguucgcugccggcagaaggagugucucuggggaucugauccucgagauuggaaaacuuccacagcaccugaccuuacgggcucaaaacgcauuggacaaucugguuaugcuccacaacuccgaacagggcgguaaagccuaccgacaugcuauggaggagcugcccgauacaauagaaacucuuaugcugcucgccuugaucgcagugcugaccgggggcguaacauuauuuuuccuaagcggaaagggccuggggaaaaccucaauuggacuccuuugugugacugcgaguagcgcccuguuguggauggcuuccgucgagccucacuggaucgccgcaucuauuauccuggaauuuuuccucauggugcugcuuauacccgagccagacagacagcgcacaccucaggauaaucaacucgcuuauguugugaucggucuguuguuuaugauucugacggucgccgcaaacgagaugggcuuacuagaaaccacuaagaaagaccuggggaucggacauguagccgcugagaaccaccagcacgcgacaaugcucgauguggaccuucaucccgccagcgcauggacccuguacgcuguugccaccacagugauuacuccaaugaugaggcacacgaucgaaaauaccacagccaacauauccuugacugcaauugcuaaucaggccgcgauccugaugggccucgauaaggguuggccuauuucaaagauggaccugggggucccgcuuuuagcucugggcugcuacucucaagugaacccccucaccuugacagccgcaguccugaugcuaguggcccauuaugcuaucauaggaccaggccugcaggcaaaagccacccgggaggcgcagaagcguacugcugccgggaucaugaaaaauccuacgguugauggaauuguggcaaucgaccucgaucccguaguguacgacgccaaguucgaaaaacagcuuggccaaauuaugcuguugauccuguguacaagucagauacuccugaugagaaccacuugggcuuuaugcgagucgauuacccuugccacagguccacugacuacccucugggaggggagcccuggaaaguuuuggaacacaacgaucgcagucuccauggcuaauaucuucaggggcucuuaucuagccggugcgggccuggccuucucauugaugaaaagccuagggggaggccgccgggggaccggagcacagggcgaaacucucggugagaaauggaagcgacagcuuaaccaacuguccaaaagugaauuuaauacauacaagagaucugggauuauggagguugacaggagcgaagcuaaagagggauugaagcgcggcgagaccacuaagcacgccgugucacgggguacagcaaaacugagaugguucgucgaacguaaccucgugaagcccgagggcaaaguaaucgauuuaggguguggaaggggcgggugguccuauuacugcgcuggacugaagaaagugaccgaaguuaagggcuauacgaaaggugggccgggacaugaggaaccaauaccuauggccaccuacggcuggaaucuugugaagcugcacaguggcaaggacgucuuuuucaugcccccagagaaaugugauacacuacucugcgacauuggggagagcucucccaacccuacuaucgaagagggacggacccugcgcguguugaagauggucgaaccguggcugcgagguaaucaguuuuguauuaaaauccucaaccccuacaugccauccgugguugagacacuugagcagaugcagagaaagcacggcgggaugcugguaaggaauccuuuaucacggaacagcacucaugaaauguauugggugucgugcggaaccggcaauauagucucugccgugaacaugacaagucgcaugcuguugaacagauucaccauggcgcacaggaaacccacuuacgagcgagauguugaccucggugcugggacgcggcauguggcagucgaaccugagguggccaaucuggauaucauuggacaacguaucgaaaacauuaagaaugagcacaaguccacauggcacuaugacgaggauaacccauacaaaaccugggcuuaucauggcagcuacgaaguaaagcccucaggcuccgccucuagcauggugaaugggguugucagacuacuuacuaaaccuugggacgugaucccaauggugacccagauugcaaugacagauacgacccccuuuggacagcaacgcgucuucaaggagaaaguugacacuaggacaccgcgggccaagagagguaccgcucagaucauggaagugacugcgaaguggcuguggggcuuucucagucgcaacaaaaagccuaggauauguacacgagaggaguucacccggaaaguaagauccaaugccgcaauuggggcuguguuugucgacgagaaccaguggaauagcgccaaggaggcaguggaagaugagagguucugggaccugguucaccgcgaacgugaguugcauaaacagggaaagugcgccacaugcguguauaacaugaugggcaagcgggagaagaagcugggugaguuugggaaagcuaagggaucuagagccaucugguacauguggcucggcgcgagguuccuugaguucgaagcacugggcuuuaugaaugaggaucacugguucucacgcgaaaacaguuuauccggggucgagggagagggucugcauaaauugggcuacauccuccgagacauuagcaagauaccagggggaaauauguaugccgaugacacugcuggcugggauacccggaucacggaagacgaucugcaaaacgaggccaaaauuaccgacaucauggaacccgagcacgcacuacuugcuacaucuauuuuuaagcugacuuaccagaauaaggugguaagaguucagaggccugccaaaaacgguaccgugauggaugucaucucgcgcagagaccagcgggggucaggacaagugggcacauauggccucaacacuuucaccaauauggaagugcagcugauaaggcagauggagagcgaggggaucuuuuucccauccgaauuggagagucccaacuuagcugaacguguccuggauuggcucgagaagcacggagccgaacgacuuaaacgcauggcaauuucuggugacgacuguguugugaagccgaucgaugacagauuugcgacggcccugauugcucuaaaugauaugggcaaaguacggaaggacaucccucagugggagcccagcaagggguggaacgauuggcaacaggugccauucugcucccaucacuuucaucagcugauaaugaaagacggaagggagauugucgugccuugucgcaaucaggaugaacucguuggcagagcccgggugucacaaggugcaggguggaguuugagggagacagcuugccugggaaagucuuacgcccagauguggcagcuuauguauuuccaccgacgugaccugagacucgcagccaacgcgaucuguagcgcuguccccguggauuggguaccaaccucccgcacuacauggucaauccacgcccaucaccaauggaugaccacugaagacauguuaagcguuuggaaucggguguggauugaggaaaaccccuggauggaggauaaaacccaugucucuuccugggaggaagugccuuaccugggcaagagggaggaccaguggugcggcaguuugauagggcugacagcaagagccacgugggcuaccaauauccagguugccauuaaccaggugcgccggcucaucggaaaugaaaacuaucuugacuacaugacuagcaugaaaagguuuaagaaugagucggauccagagggugcacugugguga

SEQ ID NO: 13202 - RNA, 9879 nt, Artificial Sequence
  derived and/or modified CDS sequence (opt3) from DENV-1__JX669473__SS-prME
agcgugaccaugcugcucaugcuucugcccaccgcauuggcuuuccacuuaacuacgagaggaggggaaccucauaugaucgucuccaagcaggaaaggggaaaaucucugcuguuuaagaccucagccgguguuaauaugugcacacucauugcaauggaccugggagaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggauugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaucgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuucaagugagauccagcuuaccgacuacggggcccugacauuggacuguagcccaagaaccggacuagauuucaacgaaaugguccugcucacuaugaaagagaagucuuggcuggugcauaaacagugguuucuugaccugccguugcccuggacauccggcgcaucaacgagccaagagaccuggaauaggcaggaucuccugguaacuuucaagacagcucacgccaagaaacaggaaguuguggucuuagguagucaagagggggcuaugcacaccgcccugacaggcgcaacugaaauccagaccucuggaacgaccacaauuuuugccggccaucuaaagugccggcucaaaauggacaagcugacucuuaaagggaccuccuaugugauguguacaggcagcuucaaguuggagaaggaagucgcugagacucagcacgguaccgugcugguucaggugaaauacgagggcacggaugcgccuugcaagauaccauucucgacacaagacgaaaaagggguaacccagaacggacgucucaucacugcaaaucccauugucacagauaaggagaaaccugugaacaucgaaaccgagccacccuuuggcgagucuuauauaguugugggugccggggaaaaggcucugaaacuuuccugguucaaaaagggcucaaguauuggaaaaauguuugaggccacugcacgcggcgccagaaggauggcuauccugggggacaccgccugggauuucggaagcaucgguggcgucuuuacauccguggggaaguugguacaucagguguucggaacggcauacggcguucucuuuucuggugucagcuggaccaugaaaauugggaucggcauucuguuaacuuggcugggacuaaauucacggaguacaucccucagcaugaccuguauagcggugggcauggugacacuguaccuuggggucaugguucaggcugacucuggaugcgugaucaacuggaagggccgagaauugaagugugguucagggauuuucgugacuaacgagguacacaccuggacggaacaauauaaauuucaggccgauaguccgaagcgccugagcgcagccaucggcagagcuugggaggagggcgucugcgguaucagguccgccacacggcucgaaaauauuauguggaaacagauaucuaacgagcugaaucauaucuuacuggaaaacgacaugaaguucaccgugguugugggcaaugcaaacgggauucuugcucagggcaagaaaaugaucaaaccucaacccauggagcacaaguacucguggaaaagcuggggcaaggccaagauuaucggggcggacauacagaaugccacuuuuaucauugauggaccagacaccccugaaugucccgaugagcagcgcgcuuggaacaucugggaggucgaagacuauggcuucgguauuuuuacaacuaauaucugguugaaacucagagauuccuacacccagaugugcgaccacaggcugaugucagcagccauaaaggauaguaaagcugugcaugccgacaugggguauuggauugagucugaaaagaacgagacauggaagcuagcacgugcgagcuucaucgaaguuaaaacguguauuuggccaaagucccacacccuguggucaaauggagugcucgagagcgagaugaucauacccaaaauguacggcgguccuaucucucaacauaacuaucggccaggcuacuucacucagacagccgggccguggcaccugggaaaacuugaauuggauuuugaccugugcgagggcaccacuguagucguggaugaacacugcgggucccgaggacccaguuuaagaacaaccacggugacuggcaaaauuauccaugagugguguugcaggagcuguacccucccuccacugcgcuuccggggugaggacgggugcugguacggaauggaaauuagacccgucaaggagaaggaagagaaucuuguuaggucuaugguguccgcuggcucaggugaaguagauaguuuuagccugggcaucuugugugugucgauaaugauugaggaggucaugcgcucccgauggucucggaaaaugcucaugacagggacccuggccguguuccuacugcucaucaugggacagcugacuuggaacgaccuuauccguuugugcauuaugguuggcgcaaaugcuagcgacaagauggggaugggaacaaccuaucuggccuuaauggcaacauuuaaaaugagaccuauguucgccgugggccuccuguuuaggcgccuuacuucacgggaaguccugcuacucaccaucggucugaguuugguggcuuccguugagcugccaaacucuuuagaagaacucggggauggacuggcgaugggcauuaugaugcuuaagcuguugacggaguuccaaccccaccagcucuggacaacccugcuaagccugacuuuuauaaaaaccacacuuucccucgacuacgccuggaagacuaccgcaacggugcugucaaucgucagcuuguucccgcuguguuuaaguacaaccucucagaagacuacauggcucccuguacugcuuggcuccuuugggugcaaaccacugaccauguucuugauuacugagaacaagaucuggggaagaaaaagcuggccccucaaugaggguauuauggcuaucggcauagugucgauccugcuaucaucucugcuuaagaacgauguuccucucgccgggccccugauugccggaggcauguugaucgcuuguuaugugauuagugguuccagcgcagacuuaucucuggaaaaagccgcggaggucagcugggaagaggaagcugagcauuccgggacaucacacaauauccucguggagguacaggaugacggaaccaugaagauaaaagaugaagagagggacgauacgcugacuauucuucugaaggccaccuugcuagcagugaguggcgucuacccaaugagcaucccugccacacuguuuguuugguauuucuggcaaaagaaaaagcagcgaucuggcgugcucugggacacccccuccccaccggaaguggagcgcgcuguccuggaugacgggaucuaccggauucuucagagaggauuacuggguaggucacaggugggcguugggguauuccaagauggaguguuucauacaauguggcacgucacucguggcgcagugcucauguaucaggguaaacgcuuggagccuaguugggccagcguuaagaaagaccugauauccuacgggggaggcuggcgguuccagggcucuuggaacaccggggaagaggugcaggucaucgcgguggaacccggaaagaauccaaagaacguacaaacgacacccgguacuuuuaaaaccccugagggcgaagucggggcuauugcccucgacuucaagccaggaacaucgggcagccccaucgugaauagagaggguaaaauuguugggcuguacggaaacggcguggucaccacuucaggcaccuauguguccgcaaucgcccaggcuaaggccagucaggaggggccucuuccggaaauagaggaugaaguuuuuaaaaagaggaaucugacaaucauggacuugcacccaggaucugguaagacgcgacgguaccuacccgcaauugugcgcgaggcuaucaaaagaaagcugaggacucucauuuuagccccuacccgggucguggcgagcgaaauggccgaggcacugaaaggcaugccaauccgauaucaaacaaccgcuguaaaguccgagcauacugggagagaaauaguggaucuuaugugccacgccacauucaccaugcgccugcucucacccguuagggucccuaacuacaauaugauuaucauggacgaggcucauuuuacggauccggcaucuaucgccgcccguggauauauuagcacucgggugggcaugggugaagcugcggcaaucuucaugacagccacacccccagggaguguggaggcuuuuccucaguccaacgccgucauacaggacgaagagagagauauucccgagaggagcuggaacucuggauacgacuggaucaccgauuucccaggcaaaacuguaugguuugugccuucaauuaaguccggcaacgacaucgcaaauuguuugcgcaagaacgggaaacgaguuauacagcugaguagaaagacauucgauaccgaauaucagaagacaaagaacaaugacugggacuacguggucacuacggauauuagcgagaugggagccaacuuccgggcugacagggugaucgauccccgccguugccucaaaccaguuauccugaaggacgguccggaaagagugauucuugcgggcccuaugcccgucaccguggccucggcagcucagcggagggggcgcaucggacgaaaucagaacaaggagggcgaucaguacguauauaugggucaaccacuaaauaacgacgaggaucacgcccauuggacagaagcaaaaaugcuguuggacaauauuaacacucccgaggggauaaucccugccuuauuugaaccagagagagaaaagucugcugccauugauggcgaguaccggcugaggggagaggcgcgcaaaaccuucguggaacucaugagaaggggcgaccugcccguuuggcuuuccuauaaggucgcaagcgagggguuucaguacucagaucggcguuggugcuucgacggagaacgcaauaaccaggugcuggaggaaaauauggauguggagaucuggacaaaagagggugaacgaaagaaacucagaccuaggugguuggacgcccggaccuauagugacccgcuggcucuacgcgaguuuaaggaguucgccgcuggcagaaggucugucuccggggaucugauccucgagauuggaaaacuuccacagcaccugacuuuacgggcacaaaacgccuuggacaaucugguuaugcuccacaacagcgaacagggcgguaaggcuuaccgacaugccauggaggagcugcccgauacgauagaaacccuuaugcugcucgcauugaucgcggugcugacagggggcguaacuuuauuuuuccuaucaggaaagggccuggggaaaaccaguauuggacuccuuugugugacagccagcuccgcucuguuguggauggccucugucgagccucacuggaucgcagcuagcauuauccuggaauuuuuccucauggugcugcuuauacccgagccagacagacagcgcaccccucaggauaaucaacucgccuauguugugaucggucuguuguuuaugauucugacugucgcagccaacgagaugggcuuacuagaaacaacgaagaaagaccuggggaucggacauguagcugcggagaaccaccagcacgccaccaugcucgauguggaccuucaucccgcauccgcuuggacucuguacgccguugccacaaccgugauuaccccaaugaugaggcacacaaucgaaaauacuacggcaaacauaucauugaccgcuauugccaaucaggcggcuauccugaugggccucgauaaggguuggccuauuucuaagauggaccugggggucccgcuuuuagcccugggcugcuacagucaagugaacccccucacauugacugcagccguccugaugcuaguggcucauuaugcaaucauaggaccaggccugcaggccaaagcgacccgggaggcucagaagcguacagccgcagggaucaugaaaaauccuaccguugauggaauuguggccaucgaccucgaucccguaguguacgacgcuaaguucgaaaaacagcuuggccaaauuaugcuguugauccuguguacuucgcagauacuccugaugagaacgacaugggccuuaugcgagagcauuacccuugcaacugguccacugaccacacucugggagggguccccuggaaaguuuuggaacacuaccaucgcugucucuauggccaauaucuucaggggcucauaucuagcgggugccggccuggcauucagcuugaugaagucccuagggggaggccgccgggggacaggagcucagggcgaaacgcucggugagaaauggaagcgacagcuuaaccaacugaguaaaucugaauuuaauaccuacaagagaagcgggauuauggagguugacaggucagaagccaaagagggauugaagcgcggcgagacuacaaagcacgcagugucccgggguaccgcuaaacugagaugguucgucgaacguaaccucgugaagcccgagggcaaaguaaucgauuuaggguguggaaggggcggguggaguuauuacugcgccggacugaagaaagugacugaaguuaagggcuauacaaaaggugggccgggacaugaggaaccaauaccuauggccaccuacggcuggaaucuugugaagcugcacagcggcaaggacgucuuuuucaugcccccagagaaaugugauacgcuacucugcgacauuggggagucuucccccaacccuaccaucgaagagggacggacacugcgcguguugaagauggucgaaccguggcugcgagguaaucaguuuuguauuaaaauccucaaccccuacaugccaucagugguugagacucuugagcagaugcagagaaagcacggcgggaugcugguaaggaauccuuuaagccggaacucgacccaugaaauguauugggugucuugcggaacaggcaauauagucagugcggugaacaugacuucccgcaugcuguugaacagauucaccauggcucacaggaaacccacauacgagcgagauguugaccucggugcagggacccggcauguggccgucgaaccugagguggcuaaucuggauaucauuggacaacguaucgaaaacauuaagaaugagcacaagagcacuuggcacuaugacgaggauaacccauacaaaacgugggccuaucauggcucauacgaaguaaagcccuccggcucugcaagcaguauggugaaugggguugucagacuacuuacaaaaccuugggacgugaucccaauggugacccagauugccaugacugauaccacacccuuuggacagcaacgcgucuucaaggagaaaguugacacgaggaccccgcgggcuaagagagguacugcgcagaucauggaagugacagccaaguggcuguggggcuuucucucccgcaacaaaaagccuaggauauguacccgagaggaguucacucggaaaguaagaagcaaugcagcuauuggggccguguuugucgacgagaaccaguggaacucugcaaaggaggccguggaagaugagagguucugggaccugguucaccgcgaacgugaguugcauaaacagggaaagugcgcuacaugcguguauaacaugaugggcaagcgggagaaaaagcugggugaguuugggaaagccaagggaucaagagcgaucugguacauguggcucggcgcaagguuccuugaguucgaagcccugggcuuuaugaaugaggaucacugguucagucgcgaaaacuccuuaagcggggucgagggagagggucugcauaaauugggcuacauccuccgagacauuucuaagauaccagggggaaauauguaugcugaugacaccgccggcugggauacacggaucacugaagacgaucugcaaaacgaggcaaaaauuaccgacaucauggaacccgagcacgcucuacuugccacgucgauuuuuaagcugaccuaccagaauaaggugguaagaguucagaggccugcuaaaaacgguacagugauggaugucaucucacgcagagaccagcgggggagcggacaagugggcacuuauggccucaacaccuucacaaauauggaagugcagcugauaaggcagauggaguccgaggggaucuuuuucccaagugaauuggagucucccaacuuagccgaacguguccuggauuggcucgagaagcacggagcagaacgacuuaaacgcauggcgauuagcggugacgacuguguugugaagccgaucgaugacagauuugccacugcucugauugcccuaaaugauaugggcaaaguacggaaggacaucccucagugggagcccuccaagggguggaacgauuggcaacaggugccauucugcucacaucacuuucaucagcugauaaugaaagacggaagggagauugucgugccuugucgcaaucaggaugaacucguuggcagagcacgggugagucaaggugcuggguggucuuugagggagaccgccugccugggaaagagcuacgcacagauguggcagcuuauguauuuccaccgacgugaccugagacucgccgcgaacgcuaucuguuccgccguccccguggauuggguaccaacgucacgcacaaccuggagcauccacgcacaucaccaauggaugacuacagaagacauguuaucuguuuggaaucggguguggauugaggaaaaccccuggauggaggauaaaacccaugucuccaguugggaggaagugccuuaccugggcaagagggaggaccaguggugcggcagcuugauagggcugacugccagagcuaccugggccacaaauauccagguugcaauuaaccaggugcgccggcucaucggaaaugaaaacuaucuugacuacaugacgucgaugaaaagguuuaagaaugaguccgauccagagggugcucugugguga

SEQ ID NO: 13203 - RNA, 9879 nt, Artificial Sequence
  derived and/or modified CDS sequence (opt3) from DENV-1__JX669474__SS-prME
agcgugaccaugcugcucaugcuucugcccacugcauuggcuuuccacuuaacuacgagaggaggggagccucauaugaucgucuccaagcaggaaaggggaaaaucucugcuguuuaagaccucagccgguguuaacaugugcacacucauugcaauggaccugggagagcuuugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaggaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggaugucuuaugugauguguacaggauccuucaaguuggagaaggaagucgcugagacucagcacgguaccgugcugguucaggugaaauacgagggcacggaugcgccuugcaagauaccauucagcacacaagacgaaaaagggguaacccagaacggacgucucaucacugcaaaucccauugucacagauaaggagaaaccugugaacaucgaaaccgagccacccuuuggcgagucguauauaguugugggugccggggaaaaggcucugaaacuuucuugguucaaaaagggcuccucaauuggaaaaauguuugaggccacugcacgcggcgccagaaggauggcuauccugggggacaccgccugggauuucggaaguaucgguggcgucuuuacaagcguggggaaguugguacaucagguguucggaacggcauacggcguucucuuuuccggugucucuuggaccaugaaaauugggaucggcauucuguuaacuuggcugggacuaaauagccggucaacaagucucuccaugaccuguauagcggugggcauggugacacuguaccuuggggucaugguucaggcugacagcggaugcgugaucaacuggaagggccgagaauugaagugugguucugggauuuucgugacuaacgagguacacaccuggacggaacaauauaaauuucaggccgauucaccgaagcgccugagugcagccaucggacgagcuugggaggagggcgucugcgguaucaggagcgccacacggcucgaaaauauuauguggaaacagauauccaacgagcugaaucauaucuuacuggaaaacgacaugaaguucaccgugguugugggcaaugcaaacgggauucuugcucagggcaagaagaugaucaaaccucaacccauggagcacaaguacucuuggaagucguggggcaaagccaagauuaucggggcggacauacagaaugccacuuuuaucauugauggaccagacaccccugaaugucccgaugagcagcgcgcuuggaacaucugggaggucgaagacuauggcuucgguauuuuuacaacuaauaucugguugaaacucagagauagcuacacccagaugugcgaccacaggcugauguccgcagccauaaaggauucaaaagcugugcaugccgacaugggguauuggauugagagugaaaagaacgagacauggaagcuagcacgugcgucuuucaucgaaguuaaaacguguauuuggccaaagagccacacccugugguccaauggagugcucgagucagagaugaucauacccaaaauguacggcgguccuacuagccaacauaacuaucggccaggcuacuucacacagaccgccgggccguggcaccugggaaaacuugaauuggauuuugaccugugcgagggcacuacaguagucguggaugaacacugcgggucucgaggacccuccuuaagaaccacgacugugaccggcaaaaucauucaugagugguguugcaggaguuguacacucccuccacugcgcuuccggggugaggacgggugcugguacggaauggaaaucagacccgucaaggagaaggaagagaaucuuguuaggagcauggugucugcuggcuccggugaaguagauucauuuagucugggcauuuugugugugagcaucaugauagaggaggucaugcgcucgcgauggucccggaaaaugcucaugaccgggacucuggccguguuccuacugcucauuaugggacagcugacauggaacgaccuuauccguuugugcaucaugguuggcgcaaaugcuucugacaagauggggaugggaaccacauaucuggccuuaauggcaacuuuuaaaaugagaccuauguucgccgugggccuccuguuuaggcgccuuaccagccgggaaguccugcuacucacgauuggucugucauugguggcuaguguugagcugccaaacuccuuagaagaacucggggauggacuggcgaugggcaucaugaugcuuaagcuguugacagaguuccaaccccaccagcucuggaccacucugcuaucucugaccuuuauuaaaacaacucuuagccucgacuacgccuggaagaccacggcaacagugcuguccauagucucauuguucccgcuguguuuaagcaccacaagucagaagacaaccuggcucccuguacugcuuggcucuuuugggugcaaaccacugacuauguucuugaucacagagaacgagauuuggggaagaaaguccuggccccucaaugaagguaucauggcuauuggcaucgugagcauacugcuaucgucacugcuuaaaaacgauguuccucucgccgggccccugaucgccggaggcauguugauugcuuguuaugugaucucugguaguuccgcagacuuaagccuggagaaggccgcggaagucucuugggaggaagaggcugagcauagcgggaccucccacaauauucucguggaaguacaggaugacggaacgaugaaaaucaaggaugaggaaagggacgauacucugaccauacuucugaaagccacauugcuagcaauuucaggcguguacccaaugaguaucccugccacccuguuugucugguauuucuggcaaaagaagaaacagcgaagcggcguucucugggacacacccucuccaccggagguggagcgcgcugugcuggaugacgggaucuaccggauucuucagagaggauuacuggguaggucccaggucggcguggggguuuuccaagauggaguauuucauacuauguggcacgugacccguggcgcaguccucauguaucaggguaagcgcuuggaaccuucaugggccagugugaaaaaggaccugauaagcuacgggggaggcuggcgguuccagggcuccuggaacacgggggaggaaguucaggugaucgcggucgagcccggcaagaauccaaagaacgugcaaacaacucccgguaccuuuaagacaccugaaggcgagguaggggcuauugcccucgacuucaaaccaggaaccucuggcucgcccaucgucaauagagaggguaagauuguggggcuguacggaaacggcguugugacuaccagcggcacauaugucucagcaaucgcccaggcuaaagccucccaggaagggccucuuccggagauagaagaugagguguuuaagaaaaggaaucugacgaucauggacuugcacccaggaagugguaagacucgacgguaccuacccgcaauuguucgcgaagcuaucaagagaaaacugaggacccucauuuuagccccuacacggguggucgcgucugagauggccgaggcacugaagggcaugccaauccgauaucaaaccacugcugugaaaagcgaacauacagggagagagauaguagaucuuaugugccacgccaccuucacgaugcgccugcucucccccgugaggguuccuaacuacaauaugauuaucauggacgaagcucauuuuacugauccggcaucaaucgccgcccguggauauauuucuacacgggucggcaugggugaggcugcggcaaucuucaugaccgccacacccccagggagcguggaggcuuuuccucagaguaacgccgugauacaggacgaggagagagauauucccgaaagguccuggaauagcggauacgacuggaucacugauuucccaggcaagacagucugguuuguaccuucuauuaaaucaggcaacgacaucgcaaauuguuugcgcaagaacgggaagcgagugauacagcuguccagaaaaaccuucgauacagaguaucaaaagacuaaaaacaaugacugggacuacguugugacgaccgauauuagugaaaugggagccaacuuccgggcugacagggucaucgauccccgccguugccucaagccagugauccugaaagacgguccggagagaguuauucuugcgggcccuaugcccgugacagucgccagcgcagcucagcggagggggcgcaucggacgaaaucagaacaaggagggcgaucaguacguguauaugggucaaccacuaaauaacgacgaagaucacgcccauuggacugaggcaaagaugcuguuggacaauauuaacacccccgaagggauaaucccugccuuauuugagccagaaagagagaaaucggcugccauugauggcgaguaccggcugaggggagaagcgcgcaagacauucguagagcucaugagaaggggcgaccugcccguguggcuuucuuauaaaguugcauccgaaggguuucaguacagcgaucggcguuggugcuucgacggagagcgcaauaaccagguccuggaagagaauauggauguggagaucuggaccaaggaaggugagagaaagaagcucagaccuaggugguuggacgcccggacuuauucagacccgcuggcucuacgcgaauuuaaagaguucgccgcuggcagaaggagugugucuggggaucugauccucgaaauuggaaaacuuccacagcaccugacguuacgggcacaaaacgccuuggacaaucuggucaugcuccacaacuccgagcagggcgguaaggcuuaccgacaugccauggaggaacugcccgauaccauagagacacuuaugcugcucgcauugaucgcgguucugacugggggcgugaccuuauuuuuccuaagcggaaaaggccuggggaagacaucaauuggacuccuuuguguaaccgccaguagcgcucuguuguggauggccuccguggaaccucacuggaucgcagcuucuauuauccuggaguuuuuccucaugguccugcuuauacccgagccagacagacagcgcacuccucaggauaaucaacucgccuaugugguuaucggucuguuguuuaugauucugacaguggcagccaacgaaaugggcuuacuagagacgaccaaaaaggaccuggggaucggacaugucgcugcggaaaaccaccagcacgccacuaugcucgauguagaccuucaucccgcaagcgcuuggacacuguacgccguggccaccaccguuauuacaccaaugaugaggcacacuaucgagaauacgaccgcaaacauauccuugacagcuauugccaaucaggcggcuauccugaugggccucgauaaagguuggccuauuucaaagauggaccugggggugccgcuuuuagcccugggcugcuacucucaagucaacccccucacuuugaccgcagccgugcugaugcuagucgcucauuaugcaaucauaggaccaggccugcaggccaaggcgacacgggaagcucagaaacguaccgccgcagggaucaugaagaauccuacuguggauggaauuguugccaucgaccucgaucccgugguauacgacgcuaaauucgagaagcagcuuggccaaauuaugcuguugauccuguguacgagucagauacuccugaugagaacaaccugggccuuaugcgagucgauuacucuugcaaccgguccacugacaacucucugggaagggagcccuggaaaauuuuggaacaccacaaucgcuguguccauggccaauaucuucaggggcucuuaucuagcgggugccggccuggcauucucauugaugaaaagccuagggggaggccgccgggggacgggagcucagggcgagacccucggugaaaaguggaaacgacagcuuaaccaacuguccaagagugaguuuaauacuuacaaaagaucugggauuauggaagucgacaggagcgaggccaaggagggauugaaacgcggcgaaacaaccaagcacgcaguuucacgggguacugcuaagcugagaugguucguggagcguaaccucgucaaacccgaaggcaaggugaucgauuuaggguguggaaggggcgggugguccuauuacugcgccggacugaaaaagguaacagaggugaaaggcuauaccaagggugggccgggacaugaggaaccaauaccuauggccacguacggcuggaaucuuguuaaacugcacaguggcaaggacguguuuuucaugcccccagagaagugugauacccuacucugcgacauuggggaaagcucucccaacccuacaaucgaggaaggacggacucugcgcgucuugaaaaugguggagccguggcugcgagguaaucaguuuuguauuaagauccucaaccccuacaugccauccgucguggagacccuugaacagaugcagagaaaacacggcgggaugcugguuaggaauccuuuaucacggaacagcacacaugagauguauuggguaucgugcggaacuggcaauauagugucugcggucaacaugaccagucgcaugcuguugaacagauucacaauggcucacaggaagcccaccuacgaacgagauguggaccucggugcagggacucggcauguugccguggagccugaagucgcuaaucuggauaucauuggacaacguaucgagaacauuaaaaaugagcacaaguccacguggcacuaugacgaagauaacccauacaagacaugggccuaucauggcagcuacgaggugaaacccucaggcuccgcaucuagcaugguaaauggggugguuagacuacuuaccaagccuugggacgucaucccaauggugacucagauugccaugaccgauacaacgcccuuuggacagcaacgcguguucaaagaaaaggucgacaccaggacuccgcgggcuaaaagagguacagcgcagaucauggagguuaccgccaaguggcuguggggcuuucucagucgcaacaagaaaccuaggauauguacucgagaagaguucacacggaaggugagauccaaugcagcuauuggggccguauuuguggacgagaaccaguggaauagcgcaaaagaagccgucgaggaugaaagguucugggaccuggugcaccgcgagcgugaauugcauaagcagggaaaaugcgcuaccugcguuuauaacaugaugggcaagcgggagaagaaacugggugaguuugggaaggccaaaggaucuagagcgaucugguacauguggcucggcgcaagguuccuugaguucgaggcccugggcuuuaugaaugaagaucacugguucucacgcgagaacaguuuauccgggguggagggagaaggucugcauaaguugggcuacauccuccgagacauuagcaaaauaccagggggaaauauguaugcugaugacacagccggcugggauacucggaucaccgaggacgaucugcaaaacgaagcaaagauuacggacaucauggagcccgaacacgcucuacuugccaccucuauuuuuaaacugacauaccagaauaaggucgugagaguacagaggccugcuaagaacgguacuguuauggaugugaucucgcgcagagaccagcgggggucaggacaagucggcaccuauggccucaacacauucacuaauauggaggugcagcugauaaggcagauggagagcgaagggaucuuuuucccauccgaguuggaaagucccaacuuagccgagcgugugcuggauuggcucgaaaaacacggagcagagcgacuuaagcgcauggcgauuucuggugacgacugugucguuaaaccgaucgaugacagauuugccaccgcucugauugcccuaaaugauaugggcaaggugcggaaagacaucccucagugggagcccagcaagggguggaacgauuggcaacagguaccauucugcucccaucacuuucaucagcugauaaugaaggacggaagggaaauuguggucccuugucgcaaucaggaugagcucgugggcagagcacggguuucacaaggugcuggguggaguuugagggaaacggccugccugggaaaaucuuacgcacagauguggcagcuuauguauuuccaccgacgugaccugagacucgccgcgaacgcuaucuguagcgccgugcccgucgauugggugccaacaucccgcaccacuuggucaauccacgcacaucaccaauggaugacaaccgaggacauguuaagcguauggaaucggguuuggauugaagagaaccccuggauggaggauaagacucaugugucuuccugggaagaggucccuuaccugggcaaaagggaagaccaguggugcggcaguuugauagggcugaccgccagagcuacaugggccacgaauauccagguggcaauuaaccagguucgccggcucaucggaaaugagaacuaucuugacuacaugaccagcaugaagagguuuaaaaaugagucggauccagaaggugcucugugguga

SEQ ID NO: 13204 - RNA, 9879 nt, Artificial Sequence
  derived and/or modified CDS sequence (opt3) from DENV-1__JX669475__SS-prME
agcgugaccaugcugcucaugcuucugcccacagcauuggcuuuccacuuaacuacgcgaggaggggagccucauaugaucgucuccaagcaggaaaggggaaagucucuguuguuuaagaccucagccgguguuaauaugugcacccucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauuuucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagagaaaagcuggcuggugcauaaacagugguuucuugaccugccguugcccuggacgucuggcgcauccaccucacaagaaacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggaaaggcuugggaggagggcgucugcgguaucagaagcgccaccaggcucgaaaauauuauguggaagcagauauccaacgagcugaaucauaucuuacuggaaaacgacauuaaauucacugugguugugggcaaugcaaacgggauccuugcucagggaaagaaaaugauucggccucaacccauggagcacaaguacucuuggaagucguggggcaaagccaagaucauaggggcggacauccagaauaccacauuuauuaucgauggaccagacacuccugaaugucccgaugagcagcgcgccuggaacauuugggaggucgaagacuauggcuucgguaucuuuaccacaaauauaugguugaaacucagagauagcuacacgcagaugugcgaccacaggcugauguccgcugcaauuaaggauucaaaagccgugcaugcugacaugggguauuggaucgagagugaaaagaacgagaccuggaagcuagcccgugcaucuuucauugaaguuaaaacuuguaucuggccaaagagccacacacugugguccaauggagugcucgagucagagaugauaauccccaaaauguacggcgguccuauuagccaacauaacuaucggccaggcuacuucacccagacugcggggccguggcaccugggaaaacuugaauuggauuuugaccugugcgagggcacaaccguagucguggaugaacacugcgggucucgaggacccuccuuaagaacgacuaccgugacaggcaaaaucauucaugagugguguugcaggaguuguacccucccuccacugcgcuuccggggugaggacgggugcugguacggaauggaaaucagacccgucaaggagaaggaagagaaucuuguuaggagcauggugucugccggcuccggugaaguagauucauuuagucugggcauauugugugugagcauuaugaucgaggaggucaugcgcucgcgauggucccggaaaaugcucaugacugggacacuggcuguguuccuacugcucaucaugggacagcugaccuggaacgaccuuauucguuugugcaucaugguuggcgccaaugcaucugacaagauggggaugggaacaacuuaucuggcuuuaauggccaccuuuaaaaugagaccuauguucgcagugggccucagcuuuaggcgccugacgucacgggaaguccuucugcuaacaauuggucucagucugguggccuccguugaguugccaaacucucuggaagaguuaggggauggacucgcuaugggcauaaugaugcugaaacuucugaccgaguuccaaccccaccaguuguggacuacccuccugagccuaacauuuaucaaaacuacccugucccuugacuacgcguggaagacgacagccauggugcucucaauugucagccuguucccguugugucugaguaccacuucucagaagacaaccugguuaccuguacuccugggcuccuuugggugcaaaccacuuacuauguuccugaucacagagaacgagauuuggggaagaaagagcuggcccuugaaugaagguaucauggcaauaggcaucgugucgauucuccugucaucucuacugaaaaacgauguuccucuugcugggccccucaucgccggaggcaugcugauugccuguuaugugaucagugguuccagcgcugacuugucuuuagagaaggcagccgaagucagcugggaggaagaggcggagcauuccgggaccucacacaauauacugguggaaguacaggaugacggaacgaugaaaauuaaggaugaggaaagggacgauacucucaccauccugcuuaaagcuacacuguuggccgugaguggcgucuacccaaugagcaucccugcaacccuauuuguuugguauuucuggcaaaagaagaaacagcgaucuggcgugcugugggacacacccuccccaccggagguggagcgcgccguccucgaugacgggauuuaccggauacugcagagaggacuuuuagguaggucacaggugggcguugggguauuccaagauggaguguuucauacuauguggcacgucacccguggcgcugugcugauguaucaggguaagcgccucgaaccuaguugggcaagcguuaaaaaggacuugaucuccuacgggggaggcuggcgguuccagggcucuuggaacacgggggaggaagugcaggucauugccguggagcccggcaagaauccaaagaacguacaaacaacucccgguaccuuuaagacaccugaaggcgaggucggggcgaucgcucuggacuucaaaccaggaaccucgggcagccccauugugaauagagaggguaagaucguugggcucuacggaaacggcguggucacuaccucaggcacauauguguccgccauagcacaggccaaagcuagucaggaagggccucugccggagaucgaagaugagguuuuuaggaagcgaaaucuuacgauuauggaccugcacccaggaucugguaaaacucggcgcuacuugcccgccaucgugagagaagcaauuaagaggaagcuacggacccugauccucgcuccuacacgagucguggccagcgagauggcggaggccuuaaaaggcaugccaauaagauaucaaaccacugcaguaaaguccgaacauacagggcgcgagauuguggaucugaugugccacgcuaccuucacgaugaggcuucugucacccguucgugucccuaacuacaauaugaucaucauggacgaagcccauuuuacugauccggcuucuauugcagcccggggauauaucagcacaagagugggcaugggugaggccgcugcgauauucaugaccgcaacacccccagggaguguggaagccuuuccucaguccaacgcugucauucaggacgaggagagggauauccccgaacgcagcuggaacucuggauacgacuggauuacugauuucccaggcaaaacaguaugguuugugccuucaaucaaguccggcaacgacauagccaauugucucagaaagaaugggaagagaguuauucaguugagucggaagaccuucgauacagaguaucagaagacuaagaacaaugacugggacuacguggucacgaccgauaucagcgaaaugggagcaaacuucagggccgaccgcgugaucgauccccguagaugccugaaaccaguuauucucaaggacgguccggagcgggugauccuggcuggcccuaugcccgucacaguggcgucggccgcacagaggcgcgggcgaauuggaagaaaucagaacaaagagggcgaucaguacguauauaugggucaaccacuuaauaacgacgaagaucacgcucauuggacugaggccaagaugcuacuggacaauauaaacacccccgaagggaucauuccugcauuguuugagccagaacgggagaagucugccgcuaucgauggcgaguacagguuacgcggagaagccagaaaaacauucguggagcugaugaggcggggcgaccuccccguuuggcuguccuauaaggucgcgagcgaaggguuucaguacucagaucgucgcuggugcuucgacggagagcgaaauaaccaggugcuugaagagaauauggauguggagaucuggaccaaagaaggugagagaaagaaacugaggccucgguggcucgacgcacgcacuuauagugacccguuggcccugagagaauuuaaggaguucgcugccggcaggcggucugucuccggggaucuaauucuggaaauaggaaaacucccacagcaccuuacgcugcgagcucaaaacgcauuagacaauuugguuaugcugcacaacagcgagcagggcgguaaggccuacagacaugcuauggaggaacuccccgauaccaucgagacacugaugcuucuggcccucauugcaguguugacugggggcguaacccuguuuuucuuaucaggaaagggccuagggaaaacaaguaucggacugcucugugugaccgcgagcuccgcccuucuguggauggcuucugucgaaccucacuggauugccgcaagcaucauauuggaguuuuuccugauggugcuccugauccccgagccagaccgccagaggacuccucaggauaaucaacuugcuuauguugugauuggucuccuguuuaugaucuugacagucgccgcaaacgaaaugggccuguuagagacgaccaagaaagaccuagggauuggacauguagccgcugaaaaccaccagcacgcgacuaugcuggauguggaccuccaucccgccuccgcauggacacuuuacgcuguugccaccaccgugaucacaccaaugaugcggcacacuauagagaauacgaccgccaacauuucacugacagcaaucgcuaaucaggccgcgauuuugaugggccuggauaaggguuggccuaucucuaaaauggaccucggggucccgcugcuugcuuuaggcugcuacagucaagugaacccccugacucucaccgccgcagucuugaugcugguggcccauuaugcuauaaucggaccaggccuacaggcaaaggccacacgugaagcgcagaagagaaccgcugccgggauuaugaaaaauccuacuguugauggaaucguggcaauugaccuggaucccguaguguacgacgccaaguucgagaaacagcucggccaaaucaugcuucugauauuguguacgucgcagauucugcucaugaggacaaccugggcucugugcgagagcaucacuuuagccaccgguccacuuacaacucugugggaaggguccccuggaaaguuuuggaacaccacaaucgcagucucuauggcuaauauuuuccgcggcucauaucucgccggugcgggccuagccuucagccugaugaaaucccuagggggaggccggcgagggacgggagcacagggcgagacccugggugaaaaguggaagagacagcucaaccaacuuaguaaaucugaguuuaauacuuacaagaggagcgggaucauggaaguugaccgcucagaggcuaaagagggacugaagcggggcgaaacaaccaaacacgccguguccagagguacugcaaaguugcguugguucgucgagaggaaccuggugaagcccgaaggcaaaguaauagaucucggguguggacggggcggguggaguuauuacugcgcuggauuaaagaaagugacagagguuaagggcuauaccaaaggugggccgggacaugaggaaccaauuccuauggccacguacggcuggaaucuggugaaacuucacagcggcaaagacgucuuuuucaugcccccagagaagugugauacccugcuaugcgacaucggggaaucuucccccaacccuacaauugaggaaggacgcacucuccgagugcugaagauggucgagccgugguugagagguaaucaguuuuguaucaaaauacugaaccccuacaugccaucagugguugagacccucgaacagaugcagaggaagcacggcgggaugcuuguacggaauccucugagccgcaacucgacacaugagauguauugggugucuugcggaacuggcaauaucgucagugccgugaacaugaccuccagaauguuacugaacagguucacaauggcgcaccgaaaacccaccuacgaacgggauguugacuugggugcugggacucgucauguggcagucgagccugaaguggccaaucucgauauuaucggacaaagaauugagaacaucaagaaugagcacaaaagcacguggcacuaugacgaagauaacccauacaagacaugggcuuaucauggcucauacgagguaaagcccuccggcucugccagcaguauggugaaugggguuguccgccugcuaaccaaaccuugggacgugauuccaauggugacucagaucgcaaugaccgauacaacgcccuuuggacagcaaagggucuucaaggaaaaaguugacacccggacuccgagagccaagcgcgguacagcucagauaauggaggugaccgcgaaauggcuuuggggcuuucuguccaggaacaagaagccucgaauuuguacucgggaagaguucacaagaaaaguaaggagcaaugccgcaaucggggcuguguuugucgacgagaaccaguggaacucugccaaggaagcaguggaggaugaacgcuucugggaccucguucaccgugagcgggaacugcauaaacagggaaagugcgcuaccugcguguauaacaugaugggcaaaagagagaagaaguugggugaguuugggaaagccaagggaucaagggccaucugguacauguggcugggcgcgcgcuuccucgaguucgaggcacuuggcuuuaugaaugaagaucacugguucagucgagagaacucccugagcggggucgagggagaagguuuacauaaacugggcuacauuuugcgggacauaucuaagaucccagggggaaauauguaugccgaugacacagcuggcugggauacuagaauuaccgaggacgaucuccaaaacgaagccaaaaucacggacauuauggagcccgaacacgcacugcuagcuaccucgaucuuuaaacuuacauaccagaauaaagugguaaggguucagcgcccugccaagaacgguacugugauggaugucauaucaagacgggaccagagggggagcggacaagugggcaccuauggccugaacacauucacuaauauggaggugcagcucauccgucagauggaguccgaagggauauuuuucccaagugagcuggaaucucccaacuuggcugagcgagucuuagauuggcuggaaaagcacggagccgagcgccucaaaagaauggcaaucagcggugacgacuguguugugaagccgauugaugaccgguuugcgaccgcccuuaucgcucugaaugauaugggcaaaguaaggaaggacauaccucagugggagcccuccaaaggguggaacgauuggcaacaggugccauucugcucacaucacuuucaucagcuaauuaugaaggacggacgcgaaaucgucgugccuuguagaaaucaggaugagcugguuggccgggccagggugagucaaggugcaggguggucucuccgagaaacggcuugcuugggaaagagcuacgcccagauguggcagcugauguauuuccaccguagagaccuucgccuggcagccaacgcgaucuguuccgcuguccccguggauuggguaccaacaucacggaccacuuggagcauucacgcccaucaccaauggaugacaaccgaggacaugcucucuguuuggaauaggguguggauagaagagaaccccuggauggaggauaaaacucaugucuccaguugggaagaggugccuuacuuaggcaagagagaagaccaguggugcggcagccugaucggguugaccgcacgcgccacaugggcuacgaauauucagguugccaucaaccaggugcggaggcugauuggaaaugagaacuaucucgacuacaugaccucgaugaaacgauuuaagaaugaguccgauccagaaggugcacuuugguga

SEQ ID NO: 13205 - RNA, 9879 nt, Artificial Sequence
  derived and/or modified CDS sequence (opt3) from DENV-1__JX669461__SS-prME
agcgugaccaugcugcucaugcuucugcccacugccuuggcuuuccacuuaacuacgagaggcggggagccucauaugaucgucuccaagcaggaaagaggaaaaucucugcuguuuaagaccucaguuggugugaacaugugcacacucauugccauggaccugggcgagcuuugugaagauacuaugaccuacaaaugcccacggauaaccgaggccgaaccggacgauguagacuguuggugcaaugcgaccgauacuugggugacauaugggaccuguagucaaacgggagagcaccgccgagacaagcguagcgucgcucuggcaccccaugugggcuugggucucgagacuagaaccgaaacauggauguccucugagggggcauggaaacagauccagaagguugaaacuugggcccugagacacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaggaacaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagaaaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggaucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacuaaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgugaaugggauccucgcccagggaaagaaaaugauucggccucaacccauggagcauaaguauuccuggaagucuuggggcaaagcaaagaucauaggggcugauauccagaacacuaccuuuauuaucgacggaccagauacaccugaaugucccgacgaucagcgcgccuggaauauuugggaggucgaggacuacggcuucgguaucuuuacuaccaacauauggcugaaacuaagagauucgcacacacagaugugcgaccacaggcugaugagcgcggccauuaaggauuccaaagcugugcaugcagacaugggguauuggaucgaaucagagaagaaugaaacguggaagcucgcccgugcuaguuucauugagguuaaaaccuguaucuggccaaagucucacacucuguggagcaacggagugcuugaauccgagaugguaauacccaaaaucuacggcgguccuauuucacaacauaauuaucggccaggcuacuucacacagaccgccgggccguggcacuugggaaagcuggaguuagauuuugaccucugcgaaggcacuacagucgugguggaugagcacugcggguaccgaggacccagccugagaaccacgacugucaccggcaaaaucauucaugaaugguguugcaggucuuguacacuuccuccacugcgcuuccggggugaggacgggugcugguauggaauggagaucagacccguuaaggaaaaggaggaaaacuuggugagguccaugguaagugcaggcagcggugagauggacucuuuuucccucggcauacugugugugucaauucuaaucgaagaggucaugcgcagucgauggagccggaaaaugcugaugaccgggacucucgcgguguuccugcuuuugaucaugggacagcugacauggaaugauuuaauucgucucugcaucaugguuggcgccaacgcuucggacaagauggggaugggaaccacauaccuggcccuuauggcaacucugaaaaugagaccuauguuugcugugggccuacucuucaggcgccugaccucccgggaggucuugcuguuaacggugggucucucucugguugccagcguggaacuuccaaauucacuggaggaauugggggauggacucgcaaugggcauuaugaugcugaagcuacugacagacuuucaaccccaccagcuuuggaccacucuccugaguuugaccuucauaagaacaucccugucuuuagauuaugccuggaaaacuauggcuauggcgcucagcaucgucucccuguuuccgcuuugucugucaaccacgagccagaagacaaccugguugccuguacuccugggcaguuucgggugcaagccacuaacuauguuucugauuacagagaacaaaaucuggggaaggaagucuuggcccauuaacgaagguaucauggccgugggcauaguuuccauccuucucagcucgcuguugaaaaaugacgugccuuuagcagggccccugauugcuggaggcaugcucaucgccuguuacgucauuucagguucuagugccgaucugucccuugagaaggcugcagaggugagcugggaagaggaagccgagcauucugggaccagccacaacauccugguagaagugcaggacgauggaacuaugaaaauaaaggacgaggagcgagaugacacauugaccauucuacugaaagcgacgcuccuggcugucuccggcguuuauccaaugucaaucccugccacucuuuucgugugguacuuuuggcaaaagaagaaacagcgcaguggcguguuaugggauacccccagcccaccggaagucgagcgggcagugcuggacgacgggaucuauaggauucuccagaggggauugcugggucguucucagguuggcguagggguguuccaagauggagucuuccauacaauguggcacgugacccgcggcgccguucucauguaccaggguaagcggcuggaaccuuccugggcuucagugaaaaaggaccuuauaaguuacgggggaggcuggagauuucagggcagcuggaauacaggggaggagguccaggugaucgcaguagaacccggcaagaacccaaagaauguccaaacuacccccgguacguucaagacaccugagggcgaagugggggccauugcgcuggauuuuaaaccaggaacuuccggcucucccaucguuaacagggaggguaagauugugggguuguauggaaauggcgucgugaccacaucgggcaccuacguuagcgcuaucgcccaggcaaaagccacucaggaagggccucuaccggagauagaggacgaaguguucaagaaacgaaaccugaccaucauggaucuccacccaggaucagguaagacacggcgcuauuuacccgcuauugucagagaggccaucaagaggaaacugcggacgcuuauucuggcaccuacucgagugguagcuuccgaaauggccgaggcgcucaagggcaugccaaucagauaccaaaccacagccgugaaaagugaacauaccgggcgcgagauaguugacuugaugugccacgcaacuuuuacaaugaggcugcucucucccguccgugugccuaauuauaacaugauuaucauggaugaggcucauuucaccgacccggccagcaucgcugcacggggauacauuuccacgagagugggcaugggugaagccgccgcuaucuuuaugacugcgacacccccagggucagucgaggcauucccucagucuaaugccguaauacaggaugaagagagggacauucccgaacgcagcuggaacaguggauaugauuggaucaccgacuuuccaggcaagaccgugugguucguuccuuccauuaaaagcggcaaugacaucgcuaacugucugcgaaagaaugggaagagagugauacagcuuucucggaaaacuuuugauacagaguaccaaaagaccaaaaacaacgacugggauuacgucgugacaacugacauuucagagaugggagccaauuucagggcagaucgcguuaucgacccccguagaugccuaaagccagugauccugaaagaagguccggagcgggucauuuuggccggcccuaugcccgugacgguagcuuccgcggcccagaggcgcgggcgaaucggaagaaaccagaauaaggaaggcgaucaguauauuuacaugggucaaccauuaaacaaugacgaggaucacgcacauuggaccgaggcuaagaugcugcucgacaacauaaauacacccgaagggaucauuccugcccuguucgagccagaacgggagaaaagugcagccaucgauggcgaauauaggcuucgcggagaggcuagaaagacuuuuguggagcugaugaggcggggcgaccuccccguuugguugagcuacaaagucgccucggaaggguuccaguauucugaucgucgcuggugcuuugacggagagcgaaacaaucaggugcuggaagagaacauggacguggaaaucuggaccaaggagggugagaggaaaaagcuaaggccucgguggcuggaugcgcgcacauacuccgacccgcucgcacuuagagaguucaaagaguuugccgcuggcaggcggagcgucucaggggaucugauuuuagaaauaggaaaguugccacagcaccugacccuccgagcccaaaaugcucuggacaaccuuguuaugcugcacaauagugagcagggcgguaaggcauauagacaugccauggaggaacuccccgauacuaucgagacguugaugcuguuagcucuaauugccgugcugaccgggggcguaacacucuucuuucuuucuggaaaaggccuggggaagacuuccaucggauugcugugugugauggcaagcucagcgcuccuguggauggccagugucgaaccucacuggauugcugccagcaucauacuugaguucuuucucauggugcuguugauccccgaaccagaccgccagaggaccccucaggauaaccaacuggcauacguugugauugguuuacuauucaugauccugacagucgcugccaaugagaugggccuccuugagaccacuaaaaaggaccuggggauuggacauguagcaguggaaaaccaccaccaugccacaauguuggauguugaccugcggcccgcuuccgcguggacgcucuacgccguggcaaccacugucaucacaccaaugaugcgucacaccauagagaacaccacagcuaauauuucucugacugccaucgccaaccaggcagcuauucuuaugggcuuagauaaagguuggccuaucagcaagauggacauaggggugccgcugcucgccuugggcugcuauucccaggucaauccccugacgcuaaccgcggcugugcugaugcucguugcccauuacgcaaucauuggaccaggccuucaagccaaggcuacaagagaagcacagaaaaggacugccgcggggaucaugaagaacccuaccguggauggaauuguaacaaucgaccuggaccccguggucuaugaugcuaaauuugagaagcaguugggccagauaaugcugcucauucuguguaccucacaaaucuuacuuaugcgcacuacgugggcccugugcgaaucuaucacacucgcaaccgguccacuaacuacccugugggaggggaguccuggaaaauucuggaauacaacuauugccguuucgauggcuaacaucuuucggggcagcuacuuggccggugcaggccuggcuuucucccucaugaagucucuugggggaggccgaagagggaccggagcccagggcgagacacugggugaaaaguggaaaaggcaguugaaucagcugucaaagagcgaguucaacacguauaaaaaguccgggauaauggaaguggaccgcagugaggcgaaagaaggacucaagcggggcgagaccacuaagcacgccgucucuagagguacagcaaaauuacguugguuuguggagaggaaucugguaaagcccgaaggcaaagugauugaucuuggguguggacggggcggguggagcuacuauugcgcuggacugaagaaaguuaccgaggugaagggcuacacuaaaggugggccgggacaugaggaaccaaucccuauggccacauacggcuggaaccuagucaagcuccacucaggcaaggacguguucuuuacacccccagaaaaaugugauacgcuguugugcgacauuggggaguccagucccaauccuaccaucgaggaaggacgcacacugcgaguccucaagaugguggagccguggcuuagagguaaccaauucuguauaaaaauccugaaucccuauaugccaagcguuguagaaacuuuagagcagaugcagaggaagcacggcgggaugcuggugcggaacccuuugucucgcaauuccacccaugagauguacugggucucaugcggaacaggcaacauugugagcgcaguuaauaugacuucgagaaugcuccugaacagguuuaccauggcucaccgaaaacccacauaugaacgggauguggaccuaggugccgggacccgucaugucgccguggagccugaaguagcgaaccuugauaucauuggacagagaaucgagaauauuaagaacgaacacaagucuacuuggcacuacgacgaggauaauccauauaaaacgugggcuuaccauggcaguuaugaggugaagcccuccggcagcgcaucauccaugguuaacggggucgugcgccugcucacaaaaccuugggacgugaucccaauggucacccaaauagccaugacugacaccacacccuucggacagcagaggguuuuuaaggaaaaaguggauacgcggaccccgagagcuaagcgcgguacugcccaaauuauggagguaacagcaaaguggcuguggggcuucuugucuaggaauaaaaagccucgaaucuguacccgggaagaguuuacuagaaaagugaggagcaacgccgcuaucggggcggucuucguggacgaaaaucaguggaacagugccaaggaggcaguugaggaugaacgcuuuugggaccuggugcaccgugagcgggaacuccauaaacagggaaagugcgcuacaugcgucuacaauaugaugggcaagagagagaagaaacuuggugaguucgggaaagccaaaggauccagggcaauuugguacauguggcugggcgcccgcuuuuuagaguucgaggcucugggcuucaugaacgaagaucacugguuuagccgagaaaauucuuugucagggguggaaggagagggucuccauaaacugggcuauauacuacgggacaucaguaagauuccagggggaaacauguacgccgaugacaccgcgggcugggauacaagaaucacugaggacgaucuucagaaugaagcaaaaauuaccgacaucauggagcccgaacacgcccugcucgcuacguccauauucaagcugaccuaucaaaacaagguaguuagggugcagcgcccugccaaaagcgguacagucauggaugugaucucuagacgggaccagagggggucgggacaggugggcacuuacggcuugaauaccuuuacaaacauggagguccaauuaauucgucagauggaaucagaggggaucuucagcccauccgagcuggaaacucccaaccucgcaaagaaaguucuugacuggcuggagaagcacggagcugaacgacuaaaacgcauggccauuaguggugaugacugugugguaaagccgaucgaugacagauuugcuaccgcccugacggcacucaaugauaugggcaaggugcggaaagacauaccucagugggagcccucuaagggguggaacgauuggcagcaagucccauucugcagccaucacuuucaucaguugauuaugaaagacggaagggaaaucgugguuccuugucgcaaucaggaugagcuggugggcagagcgcgggucucccagggugccggguggucacuuagggagacagcuugccugggaaagaguuaugcccaaauguggcagcucauguacuuccaccgacgugacuuaagacuggcagcuaacgccaucuguucugcagugcccguagauuggguuccaaccagccgcacuacaugguccauucacgcccaucaccaguggaugaccacugaagacauguugucaguguggaaucgggucuggauagaggaaaaccccuggauggaggacaaaacccaugugagcucuugggaagagguuccuuaucugggcaagagggaggaucaauggugcggcucccucaucgggcuuacagcgagagcuacgugggccaccaauauucagguggcaaucaaccagguccgccggcugauuggaaaugaaaacuaccuagacuacaugacaaguaugaagagguuuaaaaaugagagcgauccagaaggugcccugugguga

SEQ ID NO: 13206 - RNA, 9879 nt, Artificial Sequence
  derived and/or modified CDS sequence (opt3) from DENV-1__KF184975__SS-prME
agcgugaccaugcugcucaugcuuaugcccacagcacuggcuuuccacuugacuacgagaggcggggagccucauaugaucgucuccaagcaggaaagaggaaaaucuuuacuguuuaagaccucagccgguguuaacaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguugacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccgaggaccagcaucaagugggaaaugaaacuacggagcacgguacaaucgccaccauuacuccccaggcgccuaccagugaaauccagcucacagacuacggcgcccuuacccuggauuguagcccaaggacuggguuggacuucaacgagaugguccuacugacaaugaaggagaaaucuuggcucgugcauaagcagugguuucuggaucuuccgcugcccuggacguccggagcaucaaccagccaagaaacuuggaaucggcaggacuugcucguaacauucaaaaccgcucacgccaagaagcaggagguugugguccugggcagucaagaaggugcuaugcacacagccuuaacuggggcaaccgagauccagacgucuggcaccacaacuauuuuugccggacaucugaaaugccgucuaaagauggauaaacucacccugaagggcauguccuaugugauguguacagggagcuucaaacuugaaaaggaggucgcugagacucagcacggaaccguguugguucaggugaaguacgaagguacggacgcgccuugcaaaauaccauucucgauccaagaugagaagggcguaauucagaacgggcgccugaucacagcaaaucccauagucaccgacaaagaaaagccugugaacauugagacugagccacccuuuggagaaucuuauaucguugugggcgccggugagaaaacacucaagcuguccugguucaagaaagggucaaguaucggcaagauguuugaagcuaccgccagaggagcaaggcggauggccauucuuggcgauacugcuugggacuucgggagcaucggaggugucuuuaccuccgugggcaaacugguacaucagguguucgggacagccuacggaguuuuguuuucuggcgucagcuggacgaugaagauugguauagggauccuccugaccugguuaggccuaaauucacgaaguacuucccuaagcaugacauguauugcagugggaauggugacccucuaccugggcgucaugguucaggcggauucugggugcgugaucaacuggaaaggacgcgagcuuaaguguggcucagguaucuucgugacaaaugaaguacacacuuggaccgagcaauauaaguuucaggcugacaguccgaaaagauugagcgccgcaauugggaaggccugggaggaaggagucugcggcauaagguccgcuacgcggcuggagaacgugauguggaaacagaucucuaacgaacucaaucauauucuguuagagaacgacaugaaguucacaguuguggucggugaugugaauggcauccuggcccaggggaaaaagaugguucgcccucaacccauggaacacaaauacucguggaaaagcuggggaaaggcaaagauuaucggcgcugacauacagaacaccacuuuuaucauugaugggccagacaccccugagugucccgaugaccagagagccuggaauaucugggagguggaagauuauggauucggcauuuuuacaacuaacaucuggcuuaaguugagggacuccuacacccagaugugcgaucaccgucucaugucagcggccauaaaagacaguaaggcuguacaugcagauauggguuauuggauugagucugagaagaaugagacauggaagcuggcccgggcuagcuucaucgaagucaagacguguauuuggccaaaaucccacacccuauggucaaacggggugcuggagagcgagaugaucauacccaagaucuacggaggcccuacuucucaacauaauuaucgaccagguuacuucacacagaccgccggcccguggcaccucgggaaacuggaacuugacuuugauuugugcgagggaacuacaguggucguugacgaacacugcggcaacagagggcccucccugaggaccacgacugugaccggaaagauuauccaugagugguguugccgcaguuguacauuaccuccacuccgguucaaaggcgaggacgguugcugguacgggauggaaauuagacccguaaaggagaaggaagagaaucuggugaggagcauggucucugcaggauccggcgaaguggauaacuuuucacuuggucuguuguguguuaguaucaugguggaggaggucaugcgcagccgauggucgcggaaaaugcucaugaccggcacucuggcgguguuccuacugcucauaauggggcagcugacauggaaugaccuuauucguuugugcaucaugguuggagccaacgcuuccgauagaaugggcauggggaccacauaucuggccuuaauggcaacuuuuaagaugaggccuauguucgcugugggacuccuguuucgccggcuuaccucuagagaaguccugcuacucacgaucggccugagcuugguagccucaguggagcugccaaauaguuuagaagaacucggugacgggcuggcaaugggaauuaugaugcuuaaacuguugacagauuuccaaucccaccagcucuggaccacucugcuaucucugaccuuuguuaagacaacucuuagccucgacuacgccuggaaaaccauggcuauggugcuguccaucgucucauuguucccccuguguuuaagcacgacaagucagaagaccacuuggcucccggugcugcuuggcucuuuuggcugcaagccucugacaauguucuugauuaccgaaaacaaaauaugggggaggaaguccuggccacucaacgagggaaucauggcgguagguauugccagcauccugcuaucgucacugcuuaaaaaugaugugccccucgcaggcccucugauugcugggggaauguugaucgccuguuaugucauaucuggcaguuccgccgacuuaagccuggagaaggcugcagaaguuucuugggaggaagaggccgaacauagcggugcgucccacaacauccucguggaggugcaggaugacgggacuaugaaaauuaaggaugaggaacgagacgauacacugaccauccuucugaaagcuacguugcuagccgucucaggaguguaccccaugaguauuccagcaacucuguuuguuugguauuucuggcaaaagaagaaacagcgcagcggcguacucugggacaccccuucucccccagaggccgaaaaggcugugcuggacgauggcaucuaccggauacuucagagaggguuacugggaaggucccaggucggugugggcguuuuccaagacgggguguuucauacaauguggcacgucacccguggagcagugcucauguaucagggcaaacgcguagagccgucaugggccagugucaagaaagauuugauuagcuacggugggggauggcgguuccagggccuguggaauacaggcgaggaagugcagguuaucgcgguggagccugggaagaaccccagaaauguccaaacuaccccaggaacguuuaagacacccgaaggugaggugggcgcuaucgcccucgacuucaaaccugggacuuccggaucuccaauuguuaacagggaaggcaagauagugggucuguacgggaauggagucgugaccacaucgggcaccuauguaagcgcaaucgcccaggcuaaagccucacaggagggcccccuuccugagauugaagaugagguguuucgaaagcggaaccugacuaucauggacuugcacccgggguccggaaaaacccgcagauaccuaccagcaauuguuagggaagcuaucaagcggaagcugcgaacacucauauuagcccccacgagagucguggcgagugagauggccgaagcacugaaagguaugccuauccgcuaucaaacuaccgcugugaagacagagcauaccggcagggagauugucgaucuuaugugccacgccacuuucacaaugcgucugcucucuccaguacgggugcccaauuacaacaugaucauuauggacgaagcucauuuuaccgauccugcaagcaucgccgccagaggguauauauccacgaggguuggaaugggcgaggcugcggcaauuuucaugacugccacaccgcccgguucaauggaggcuuuuccacagucuaaugccgugauccaggacgaggaacgcgauaucccugagcgaagcuggaacaguggguacgacuggauuaccgacuuccccggaaaaaccgucugguuugugccauccaucaagagcggcaaugauauagcaaacuguuugaggaagaauggcaagcggguuauucagcugucuaggaagacuuucgacacagaguaucagaaaaccaagaacaacgauugggacuacguggucacaacugauaucucagaaaugggggccaauuuccgcgcugaccgugugauugauccuagacggugccucaaacccguaauccugaaggacggaccagagagggugauacuugcggguccgaugccuguuacggucgccuccgcagcucagcgccgaggcagaauugggcggaaccagaauaaagaaggagaucaguacguguauaugggccaaccccuaaacaaugacgaggaucacgcccauuggaccgaggcaaagaugcuguuggacaacaucaauacaccagaagguaucauucccgccuuauuugagccugaaagggagaagagugcugccaucgauggggaauaccgccugagaggcgaggcgaggaaaacuuucguggagcucaugcggcguggagaccugccagucuggcuuagcuauaagguugcaucggaaggcuuucaguacucugaccgccgauggugcuucgauggggagagaaacaaucaggugcuggaagagaacauggacguagaaauuuggaccaaagagggagagaggaagaaacuccggccccgcugguuggaugccagaacauauuccgacccucuggcucuaagggaauuuaaggaguucgccgcuggucggcgaagcgugucaggcgaucugauacucgaaaucgggagacuuccgcagcaccugaccuuaaaagcacaaaaugccuuggacaaccuggucaugcuccacaauagugagcagggaggcaaggcuuaccgccaugccauggaggaacugccagauacuauugagacgcuuaugcugcucgcauugaucgcggugcugaccggugggguuacauuauuuuuccuaucuggcaagggacugggcaaaacuuccaucgggcuccuuugugugauggccagcucaguccuguuguggauggcuaguguagaaccccacuggauugccgcaagcauaauccuggaguuuuuccucauggugcugcuuauuccugaacccgacaggcagcggaccccacaggauaaccaacucgcuuauguugugaucggacuguuguuuauuauccugacagucgccgcaaaugagauggguuuacuagagaccacuaagaaagaccugggcauagggcauguggccgcugaagaucaccagcacgcgacaaugcucgacgucgaucuucguccugccuccgcauggacgcuguacgcuguggccaccacuaucauuacacccaugaugagacauaccaucgagaacaccacagccaacauuucuuugacugcaaucgcuaaucaggccgcgauacugaugggacucgacaagggcuggccaauuagcaaaauggacaucgguguuccucugcuugcuuuagggugcuacucccaagugaacccgcugacgcucaccgccgcaguauugaugcugguggcccacuaugcuauuaucggccccggacuacaggcaaaggccacaagggaagcgcagaagcgcacugcugccggcauaaugaaaaauccaaccgucgaugggaucguugcaauugaccuggauccuguggucuacgacacaaaguucgagaaacagcucggacaaaucaugcuucugauuuuguguaccucacagauccugcucaugcggacuacgugggcccugugcgaaucuauaacauuagcuaccggcccccuuacuacccugugggaggguaguccagggaaguuuuggaacacaacuauugccgugucgauggcaaauaucuuccgaggaagcuaucucgcuggcgccggucuagcguucucccugaugaaaucuuugggcgggggaagaaggggcaccggggcccagggagagacacugggcgaaaaguggaagcgccagcucaaccaacuuucaaaaagcgaguuuaauacguacaagcgguccgguaucaccgaaguagauagaagugaggcaaaagaagggcugaagcguggagagacuacaaaacaugcugugucuaggggcgccgcaaaguugcggugguucguugagcgcaaccuggugaagccugaagguaaagucauugaccucggcugugggcgaggaggcuggagcuauuacugcgcuggguuaaagaaagugaccgaggucaagggauauacuaaaggcggucccgggcacgaggaaccgaucccaauggccacauacggauggaaucuggugaaacuucauucaggcaaagauguauuuuucauaccucccgaaaagugugacacccugcuaugcgauauuggcgaguccaguccaaaccccacgaucgaggaagggagaacccucaggguacugaagaugguggagccuugguugcggggaaaucaguuuuguauuaaaauccugaacccguacaugcccagcgucguggaaacacucgagcagaugcagcgcaagcacgguggcaugcuuguuagaaauccacugucuaggaacuccacucacgagauguauugggugucaugcgggaccggaaauauagucagcgccgugaacaugacaucgcgaauguuacugaaucgguucacuauggcgcaucguaaaccuaccuacgaaagagacguagauuugggcgcugguacacgccacguggcaguugagcccgaagucgccaaccucgacaucauugggcaaaggaucgagaacauuaagaaugaacauaaaucuaccuggcacuaugacgaggauaacccuuacaagacuugggcuuaucacggaaguuacgaggugaagccauccggcagcgccucauccauggugaauggcgucguucggcugcuaacgaaacccugggacgugaucccuaugguaacacagauugcaaugaccgauacuaccccauuugggcagcaaagaguguucaaggaaaaagucgacacacgcacgcccagggccaagcgaggaaccgcucagaucauggaggugacugcgaaauggcuuugggguuuucugucucggaacaagaagccgagaauauguacaagggaagaguucacccgcaaaguucguagcaaugccgcaauuggcgcuguguuugucgaugaaaaccaguggaauagugccaaggaggcaguggaggacgaacgguucugggaucucguacauagagagagggaacugcacaaacaggggaagugcgccacuugcguuuauaacaugaugggaaaacgcgagaagaaguugggcgaauuugguaaagcuaaggggucccgagccaucugguacauguggcugggagcgcgguuccucgaguucgaggcacuuggcuuuaugaaugaagaccauugguucagcagagagaacucucugucaggcguggaaggggagggauuacacaaacuggguuacaucuugagggauauuaguaagauaccuggcgggaauauguaugccgacgauacagcuggaugggacacccgcaucacagaggaugaccuccaaaacgaagccaaaauuacugacaucauggagccagaacaugcacugcuagcuaccuccauuuuuaaacuuacguaccagaauaaagucgugagagugcagcggcccgccaagagcggcaccgucauggauguuaucucuaggcgugaccagcgagguucggggcaagugggaacauauggccugaacacuuucaccaauauggagguacagcucauacgccagauggaaucagagggcaucuuucugccuagcgaguuggaaacaccaaacuuagcugagagagcccuggauuggcucgaaaagcacgggguggagcggcuuaaaaggauggcaauuuccggagacgauugugucgugaagcccacugacgaucgcuucgcgaccgcccugacggcucuaaacgacauggguaaaguuagaaaggauaucccgcagugggaaccuaguaaaggcuggaaugacuggcaacaggugcccuuuugcucucaccauuuccaccagcugauuaugaaggaugggcgggagaucgucgugccauguaggaaccaggacgagcucguaggacgagcccguguuagccaaggcgcagguugguccuugagagaaacagcuugccuggggaagucauacgcccagauguggcagcuuauguauuuucaucgccgggaccugaggcucgcagccaaugcgauauguagugcugugccugucgauugggugcccaccucuagaacuacauggagcauucacgcccaccaucaauggaugaccacugaggacauguuauccguuuggaaccgcguguggaucgaagagaauccauggauggaagauaaaacccacgucucaagcugggaggacgugcccuaccugggaaagcgggaggaucaguggugcggcucuuugaucggccugacagcaagggccacgugggcuaccaacauucagguagccauaaaucaggugcgaagacucaucgggaacgaaaauuaucuugacuacaugacuuccaugaaacgguucaagaacgagagugauccugaaggagcacugugguga

SEQ ID NO: 13207 - RNA, 9879 nt, Artificial Sequence
  derived and/or modified CDS sequence (opt3) from DENV-1__KT831765__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacucauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaagaagaugauccgcccucaacccauggagcacaaauacucguggaaaagcuggggcaaggcgaagauaaucggggccgacgugcagaauacuaccuuuauuaucgauggaccaaacacaccugaaugucccgacgaucagagagcuuggaauauuugggaggucgaggacuauggcuucgguaucuuuacuaccaacauauggcuuaaguugagggauuccuacacacaggugugcgaccaccgucucaugucagcagccauuaaagauaguaaggcuguucaugccgacaugggguauuggaucgaaucugagaaaaaugaaacguggaagcuggcacgggcgagcuucauugaggugaagaccuguaucuggccaaaaucccacacucuauggucaaacggaguacuggaaagcgagaugauaauccccaagauuuacggcgguccuaucucucaacauaaucaccgaccaggcuauuucacacagaccgccgggccguggcaccucggaaaacuggagcuugauuuugacuugugcgaaggcacuacagucgugguggaugagcauugcgggaacagaggacccucccugaggaccacgacugucaccggcaagauuauccacgaaugguguugccgcaguuguacauuaccuccacuccgguacagaggugaggacgggugcugguacggaauggagauaaggcccguuaaagaaaaggaggaaaaucuggugaaguccaugguaucugcuggcuccggugagguggacucauucagucuuggccuguuguguauuagcaucaugaucgaagaggucaugcgcucgcgauggucccggaaaaugcucaugaccgggacucuggccguguuuuuccuacugauuaugggacagcucacauggaacgaucugauccgucuuugcauuaugguuggcgcaaaugcuucugacagaauggggaugggaaccacauauuuggcccugauggcaacuuuuaagaugaggccuauguucgccgugggcuuacucuuucgccggcugaccagcagagagguccuucugcuaacgauaggucucucacugguggcuaguguugaauugccaaacucccuggaggaauuaggggauggacucgcgaugggcaucaugauucugaaacuucugacagacuuccaaucucaucaguugugggccacccuccugagccuaacuuuuaucaagaccacauucucccugcacuacgcauggaaaacuauggcuauggugcuuucaauugucagccucuuuccccuguguuugaguaccacgucucagaagacaaccuggcugccgguauuacucggcucccuggggugcaagccucuuacuauguuccugaucgccgagaauaaaauauggggaagaaagagcuggccauugaacgaagguaucauggccgugggcauuguuucgauccuccugucaucucuacugaaaaacgaugugccccuugcugggccucucauugcaggaggcaugcugaucgccuguuaugucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgagacgauacccucacuauccugcuuaaagcuacacuguuggcagucaguggcguuuacccccuaagcauuccagccacccuguuugugugguauuucuggcaaaagaagaaacagcgcucuggcgugcucugggacacgccuucacccccagaagucgagcgggcggugcuggaugacgggauauacagaaucaugcagaggggacuuuuaggucguagccagguuggcguagggguguuccaagaaaacgucuuucacacuauguggcaugugacccgcggagcuguucugauguaucagggcaagcggcucgagccgaguugggccagcgugaaaaaggacuugauuuccuacggugggggauggagacugcagggcucuuggaauacaggcgaggaaguccaggugaucgcaguagagccugggaaaaaccccaagaauguccaaaccgccccaggaacauucaagacucccgaaggugaggugggcgcuauugcccucgauuuuaaaccugggaccucgggaagcccaaucguuaacagggaaggcaagauagugggucuguacgggaauggagucgugacgacaucaggcacuuauguuuccgcaaucgcucaggccaaagcgagucaggagggcccccuuccugagauugaagacgagguguuccgaaagcggaaccugaccaucauggauuugcacccggggucuggaaaaacacgcagauaccuaccagccauugucagggaagcaaucaagcggaagcugcgaacccucauauuagcucccacuagagugguagccagcgagauggcugaagcacugaaagguaugccuauucgcuaucaaaccacagccgugaaguccgagcauacgggcaaagagaucguugaccuuaugugccacgccacuuuuaccaugaggcugcucucaccaguccgugugcccaauuacaacaugaucauuauggaugaagcucauuucacagacccuucuagcaucgcggcacggggguauauaaguaccagagugggaaugggcgaggccgcugccauuuuuaugacugcaacaccgcccgguuccgucgaagccuucccacagagcaaugcuguaauccaggaugaggaaagggacauuccugagcgcucuuggaacucaggguacgaguggaucaccgauuuucccggaaagacggugugguucguuccauccauaaaaaguggcaaugacauugcgaacuguuugcgaaagaauggcaagagagugauccagcugagccggaaaacuuuugauacagaauaucaaaagaccaaaaacaacgacugggacuacgucgugaccacugauaucucggagaugggggccaauuucagggcagaccgcguuauugauccucguagaugccucaagcccgugauccugaaagacggaccagaacgggucauucuugcugguccgaugccugugacaguagccucugcagcccagaggcgcggccgaauagggagaaaccacaauaaggagggagaucaguacaucuauaugggccagccccuaaacaaugacgaggaucacgcucauuggaccgaagccaagaugcuguuggacaacauuaauacaccagaggguaucauccccgcguuauucgaaccugagcgggaaaaauccgcagccauugauggggaguacaggcugcgcggcgaggcuagaaagacuuuuguggaacucaugaggcggggagaccugccaguuuggcuuagcuauaaagucgccucagagggcuuccaauacagugaucgucgcuggugcuuugacggggaacgaaacaaucaggugcuggaggaaaacauggauguggagauauggacgaaggagggagaaaggaagaagcucaggccccggugguuggacgcucgcaccuauucugacccucuggcacuaagagaguucaaagaauuugccgcugguaggcgguccgucagcggcgaucugauccucgagauugggaaacuuccgcagcaccugacacagcgagcccaaaaugcauuagacaacuugguuaugcugcauaauucagaacagggaggcagagcguaccgccacgccauggaggagcucccagauacuaucgaaacccugaugcuucuggcucucauugccguguugacaggugggguaacccuguucuuuuuaaguggcaagggacuaggcaaaacuagcaucgggcugcucugugugauggcauccucuguccuucuguggauggcuagcguggagccccacuggauagccgcauccaucauuuuggaguucuuucugaugguucuccugaucccugagcccgacaggcagcggacgccacaggauaaccaacuugccuauguggucauuggaaugcuauucaugauccugaccguagcugcgaaugagauggguuugcuggaaacaacuaagaaagacuuaggcauagggcauguggccguugagaaccaccaucacgcagcuaugcuagauguggaccugcauccugccucagccuggacccucuacgcagucgcuacaaccauuaucacucccaugaugcgucacacaauugaaaacacgaccgccaauaucucucuuacugcgauagcuaaccaggccgcaauccugaugggauuggauaagggcuggccaauuaguaaaauggacaucggugugccucugcucgcccuggggugcuacucgcaggucaauccgcuuacauuaaccgcugcagugcugaugcucguugcccacuaugcgauuaucggccccggauugcaagcuaaggccaccagagaggcacagaagaggacagccgcuggcauaaugaaaaacccaacuguggaugggauuguagccaucgaccuggauccuguggucuacgacgcaaaguuugaaaaacagcuaggacagaucaugcugcucauucuuuguacgagccaaauccuguugaugcgcaccacaugggcucugugcgaguccauaacucucgccaccggcccccugacaaccuuaugggaggguucuccagggaaguucuggaauacuacgauugcgguuucaauggccaacaucuuucggggaagcuaucuugcaggcgcuggucuggccuucucccucaugaaaagucuaggcgggggacgaagaggcacaggggcacagggagaaacccugggcgagaaguggaagaggcaguugaaucagcugucuaaaagcgaguucaacacuuacaagcgcucagguauuauggagguggaccgguccgaagcuaaagaggggcucaagagaggagagaccacaaaacaugccgucagucguggcacugccaaacuuaggugguuuguggaacggaaucugguaaagccugaggguaaagugaucgauuugggcugugggcgcggaggcuggagcuauuacugcgcggggcugaagaaaguuaccgaagugaagggauauacaaaaggcggucccgggcacgaggaaccgauaccaauggcuacguacggauggaaccucgucaaguuacauucuggcaaagacguguucuuugucccucccgagaagugugauacccugcuuugcgacaucggcgaguccucaccaaaucccacuauugaagaggggcgaacacugagagugcuaaagaugguugaaccuuggcucaggggaaaccaauucuguaucaaaauucugaauccguacaugcccagcguaguggagaccuuggagcagaugcagcggaagcacgguggcaugcugguccgcaacccacucucgagaaauucuacucacgaaauguauugggugaguugcgggacaggaaacaucguuuccgcaauuaauaugaccagcaggaugcuucugaaccgauuuacgauggcccaucggaaaccuaccuacgagcgugauguggacuuaggcgcugguacaagacacgucacuguggaacccgagguagccaaccuggauaucauagggcagcgcauugaaaauaucaagugugagcauaaaucaaccuggcacuaugacgaggauaacccuuacaagacaugggcauaucauggauccuacgaagugaagccaucuggcagcgccaguuccaugguuaauggcgucgugaaauugcucacuaagcccugggacgugaucccuauggucacccaaauugcuaugacagauaccacuccauucgggcagcagaggguuuuuaaagagaagguggacacgcggacacccaaagcgaagagaggaaccgcccaaauaauggaaguaacugcacgcuggcugugggguuuccuaagcaggaacaagaaaccgcgaaucugcacccgggaggaauuuacaagaaaggugaggucuaaugcugccauuggcgcagucuucguggacgagaaccaguggaacucagccaaagaggcuguugaagaugagcgcuuuugggaccuugugcaccgugaacgggagcugcacaagcaggggaaaugcgccacgugugucuauaacaugaugggaaagagagaaaagaaacucggcgaguucgguaaggcgaaagggaguagggcaaucugguacauguggcugggagcccgcuuuuuggaguucgaagcucugggcuucaugaaugaggaucauugguuuucccgagaaaacagccucucuggcguggagggggagggacuucacaagcuggguuacauuuuacgggacaucucgaaaauaucaggcgggaauauguaugccgaugacaccgcaggaugggauacuagaaucacagaagacgaucugcagaacgaggcuaagauuaccgaaaucauggagccugaacaugcccaauuggcuaaagccauuuucaagcucacuuaccagaauaagguaguuagggugcagcgcccagccaaaaauggcacagucauggacgugaucagcagacgggaucagagggguuccgggcaagugggaaccuauggccugaauacauuuacuaacauggaggcgcagcuaauacgucagauggagagugaaggcauuuucucucccagcgagcuugaaaccccuaaccuggccgagcgaguccucgacuggcuggaaaaguacgggguugagcgcuugaaaagaauggcuaucuccggagaugacugcgugguaaagccaaucgacgaucgguuugccacggcauuaaccgcucugaaugacauggguaaagugaggaaggauauuccccagugggagccgucaaagggcuggaacgacuggcaacaggucccuuucuguagucaccacuuucaucagcucauaaugaaagaugggcgcgaaaucgugguucccugcagaaaucaggacgagcuugugggacgggccagggucucucaaggcgcagguuggagccugcgagaaacagccugucuagggaaguccuaugcgcagauguggcagcugauguacuuccaccguagagaucuccgcuuggcugccaacgcaauuugcucagccgugccaguagacuggguuccuacuagccggaccacauggucuauccaugcucaccaucaauggaugacuaccgaggauaugcuguccguguggaauagggucuggauugaagagaaccccuggauggaggacaaaacgcacaucaguagcugggaagaugugccauaucuuggaaagagagaggaccagugguguggcucgcugauaggccucacagcccgcgcaaccugggcuacuaauauccagguugccauuaaccaggugcggagguuaaucgggaaugaaaacuaccuggacuacaugacauccaugaaacgauuuaagaaugagucugaucccgagggagcguugugguga

SEQ ID NO: 13208 - RNA, 9879 nt, Artificial Sequence
  derived and/or modified CDS sequence (opt3) from DENV-1__KP188567__SS-prME
agcgugacaaugcugcucaugcuucugcccacagccuuggcuuuccacuuaacuacgagaggcggggagccucauaugaucgucuccaagcaggaaagaggaaaaucucugcuguuuaagacaucaguuggugugaacaugugcacacucauugccauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggcaccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaauucuuagaaagcugugcaucgaagccaaaauauccaauacgaccacagacucuagguguccaacucaaggagaggcuaccuuggucgaggaacaggaugccaacuucguuugccggcgcacauuuguggaccgaggcugggguaauggguguggacucuucggcaagggcagccuguuaacuugcgcaaaguuuaaaugcguaaccaagcuggaggggaaaauugugcaguacgaaaaccucaaguauuccgucaucgugacaguucacaccggagaucagcaucaaguggguaaugagacuacggaacacggcacaauugcuaccaucacuccccaggccccuaccucagagauccagcuuacagacuacggggcgcugaccuuggacuguaguccaagaacuggacuagauuucaacgaaaugguccugcucacaaugaaagaaaagagcuggcuggugcauaaacagugguuucuugaccugccguugcccuggacgucuggcgccuccaccucacaagagacuuggaauaggcaggaucuccugguaacauucaagaccgcacacgcuaagaaacaggaaguuguggucuuagguagccaagagggggccaugcacacagcucugacuggcgccaccgaaauucagacgaguggaaccacaacuauauuugcaggccaucuaaagugccggcucaaaauggacaagcugacccuuaaagggaugucuuaugugauguguacaggauccuucaaguuggagaaggaagucgccgagacucagcacgguaccgugcugguucaggugaaauacgagggcacggaugcuccuugcaagaucccauuccucacacaagacgaaaaagggguaacccagaacggacgucugauuacugcgaaucccaucgucacagauaaggagaaaccugugaacauagaaaccgagccacccuuuggcgagagcuauauuguugugggugcaggggaaaaggcccuuaagcugucgugguucaaaaagggaucuuccaucggaaaaauguuugaggcuacugcccgcggcgcaagaaggauggccaucuugggggacaccgcuugggauuucggaucaauugguggccucuuuacaagugucgggaagcugauccaucagguguucggaacggccuacggcguauuauuuagcgguguguccuggaccaugaaaauugggauaggcauccugcuaacuuggcucggacuaaauucucggagcacaucacuuaguaugaccuguauugcaguuggcauggucacauuguaccugggggugauggugcaggcggacuccggaugcgucaucaacuggaagggccgagaacucaagugugguagcgggaucuucguuacuaacgaggugcacaccuggacggaacaauauaaauuucaggcugauucuccgaagcgccugucagccgcaauuggaaaagccugggaggagggcgugugcgguauaagaagugcuacaagguuagaaaauaucauguggaagcagauuagcaacgagcugaauuacauccuuuuggaaaacgacaugaaauucaccguagucgugggcgacguuaaugggauucucgcccagggaaagaaaaugaucaagccucaacccauggagcauaaguauuccuggaaaucuuggggcaaggcaaaaauaaucggggcugauauucagaacacuaccuuuaucauugacggaccagauacaccugaaugucccgacgaucagcgggccuggaauaucugggagguggaggacuacggcuucgguauauuuacuaccaacauuuggcugaagcuacgcgauucgcacacacagaugugcgaccacagacugaugagcgcggccaucaaagauuccaaggcuguccaugcagacaugggguauuggauugaaucagagaagaaugaaacguggaaacucgccagggcuaguuucaucgaggugaagaccuguauauggccaaaaucucacacucuguggagcaacggaguucuugaauccgagauggugauccccaagauuuacggcgguccuaucucacaacauaauuaucguccaggcuacuucacacagaccgccgggccguggcacuugggaaaacuggaguuagauuuugaccucugcgaaggcacuacaguagucguggaugagcacugcggguaccggggacccagccugcgaaccacgacugugaccggcaagauuauccaugaaugguguugcagaucuuguacacuuccuccacugagguuccgcggugaggacgggugcugguauggaauggagauacggcccgucaaggaaaaagaggaaaacuugguuagauccauggugagugcaggcagcggugagguagacucuuuuucccucggcauucugugugugucaauccuaaucgaagaggucaugaggagucgcuggagccgaaagaugcugaugaccgggacucucgcgguguuccugcuuuugauuaugggacagcugacauggaaugauuuaauccggcucugcauuaugguuggcgccaacgcucuggaccguauggggaugggaaccacauaccuugcccugauggcaacuuuuaaaaugagaccuauguucgcugugggccuacucuuuaggcgccugaccucgcgggaggucuugcuguuaacggugggucucucccugguugccucuguggaacuuccaagcucacuggaggaauugggggauggacucgcaaugggcauaaugaugcugaagcuacugacagacuuccaaccccaccagcuuuggaccacucuccugaguuugaccuuuaucagaacaucccugucuuuagauuaugccuggaaaacuauggcuauggcgcucagcauugucucccuguucccgcuuugucugucaaccacgagccagaagacaaccugguugccuguacuccugggcaguuuugggugcaagccacuaacuauguuccugaucacagagaauaaaauuuggggaaggaagucuuggcccaucaacgaagguauaauggccgugggcaucguuuccauucuucucagcucgcuguugaaaaacgacgugccuuuagcagggccccugaucgcuggaggcaugcucauugccuguuacgucaucucagguucuagugccgaucugucccuugagaaggcugcagaggugagcugggaagaggaagccgagcauucugggaccagccacaauauacugguagaagugcaggacgauggaacuaugaaaauuaaggacgaggagcgagaugacacauugaccauccuacugaaagcgacgcuccuggcugucuccggcguuuauccaaugucaaucccugccacucuuuuugugugguacuucuggcaaaagaagaaacagcgcaguggcguguuaugggauacccccagcccaccggaagucgagcgggcagugcuggacgacgggauuuauagaauacuccagaggggauugcugggucguucucagguuggcguagggguguuccaagauggagucuuucauacaauguggcacgugacccgcggcgccguucucauguaccaggguaagcggcuggaaccuuccugggcuucagugaaaaaggaccuuaucaguuacgggggaggcuggagauuccagggcagcuggaacacaggggaggagguccaggugauugcaguagaacccggcaagaauccaaagaacguccaaacuacccccgguacguuuaagacaccugagggcgaagugggggccaucgcgcuggauuucaaaccaggaacuuccggcucucccauuguuaauagggaggguaagaucgugggguuguauggaaacggcgucgugaccacaucgggcaccuacguuagcgcuauagcccaggcaaaagccacucaggaagggacccuaccugagaucgaggacgaaguguuuaagaaacgaaaucugacaauuauggaucuccacccgggaucagguaagacgcggcgcuauuuaccagcuaucgucagagaggccauuaagaggaaacugcggacucuuauccuggcacccacccgagugguagcuuccgaaauggccgaggcgcucaagggcaugccuauaagauaccaaacaaccgccgugaaaagugaacauacugggcgcgagauuguugacuugaugugccacgcaacauucaccaugaggcugcucucuccaguccgugugcccaacuauaauaugaucaucauggaugaggcucauuuuacggacccugccagcauugcugcacggggauacaucuccacuagagugggcaugggugaagccgccgcuauauucaugacagcgaccccgcccgggucagucgaggcauuuccacagucuaacgccguaauucaggaugaagagagggacaucccugaacgcagcuggaauaguggauaugauuggauuaccgacuuccccggcaagacugugugguuuguuccauccaucaaaagcggcaacgacauagcuaauugucugcgaaagaacgggaagagagugauucagcuuucucggaaaacauucgauaccgaguaccaaaagaccaaaaauaacgacugggauuacgucgugacuacggacaucucagagaugggagccaacuucagggcagaucgcguuaucgacccucguagaugccuaaagcccgugauucugaaagaagguccagagcgggucaucuuggccggcccgaugccugugaccguagcuuccgcggcccagaggcgcgggcgaauuggaagaaaucagaacaaggaaggcgaucaguauauauacaugggucaacccuuaaauaacgacgaggaucacgcacauuggacagaggcuaagaugcugcucgacaauaucaacacuccagaagggauuauccccgcccuguuugagccugaacgggagaaaagugcagccaucgauggcgaauauaggcuucgcggagaggcuagaaagaccuucguggagcugaugaggcggggcgaccucccaguuugguugagcuacaaagucgccucggaaggguuucaguauucugaucgucgcuggugcuucgacggagagcgaaauaaccaggugcuggaagagaauauggacguggaaauuuggacaaaggagggugagaggaaaaagcuaaggccccgguggcuggaugcgcgcaccuacuccgacccucucgcacuuagagaauuuaaagaguucgccgcuggcaggcggagcgucucaggggaucugauauuagaaaucggaaaguugccgcagcaccugacucuccgagcccaaaacgcucuggacaaucuuguuaugcugcacaacagugagcagggcgguaaggcauauagacaugccauggaggaacucccagauacgauugagaccuugaugcuguuagcucuaaucgccgugcugacagggggcguaacucucuuuuuccuuucuggaaaaggccuggggaagaccuccauuggauugcugugugugauggcaagcucagcgcuccuguggauggccagugucgaaccccacuggaucgcugccagcauaauccuugaguuuuuccucauggugcuguugauuccugaacccgaccgccagaggacaccacaggauaaucaacuggcauacguugugaucgguuuacuauuuaugauucugaccgucgcugccaacgagaugggccuccuugagacuaccaaaaaggaccuggggaucggacauguagcaguggaaaaucaccaccaugccacgauguuggauguugaccugcggccugcuuccgcguggacccucuacgccguggcaacuacagucauaacccccaugaugcgucacaccauugagaacacaacugcuaacaucucucugacggccauugccaaucaggcagcuauccuuaugggcuuagauaaagguuggccaauaagcaagauggacaucggggugccucugcucgccuugggcugcuauucccaggucaacccgcugacccuaacagcggcugugcugaugcucguugcccauuacgcaauuaucggacccggccuucaagccaaggcuacuagagaagcacagaaaaggaccgccgcggggauuaugaagaauccaacaguggauggaaucguaaccauagaccuggacccuguggucuaugaugcuaaauucgagaagcaguugggccagauuaugcugcucauccuguguacuucacaaaucuuacuuaugcgcacgacaugggcccugugcgaaucuauuacccucgcaacugguccccuaaccacacugugggaggggaguccaggaaaauuuuggaacacuaccaucgccguuucgauggcuaauauauuccggggcagcuacuuggccggugcaggccuggcuuucucccucaugaagucucuugggggaggccgaagagggacaggagcccagggcgagacgcugggugaaaaguggaaaaggcaguugaaccagcugucaaagagcgaguuuaauaccuauaaaaaguccgggauuauggaaguggaccgcagugaggcgaaagaaggacucaagcggggcgagacuacaaagcacgccgucucuagagguaccgcaaaauuacguugguucguggagaggaaccugguaaagccugaaggcaaagugaucgaucuuggguguggacggggcggguggagcuacuauugcgcuggacugaagaaaguuacugaggugaagggcuacacaaaaggugggcccggacaugaggagccgauuccaauggccaccuacggcuggaaucuagucaagcuccacucaggcaaggacguguuuuucacgccucccgaaaaaugugauacccuguugugcgacaucggggaguccaguccaaaccccacaauagaggaaggacgcacucugcgaguccucaagaugguggagccuuggcuuagagguaaucaauuuuguaucaaaauucugaacccguauaugcccagcguuguagaaaccuuagagcagaugcagaggaagcacggcgggaugcuggugcggaauccauugucucgcaacuccacacaugagauguacugggucucaugcggaacuggcaauaucgugagcgcaguuaacaugaccucgagaaugcuccugaauagguucacaauggcucaccgaaaaccuaccuaugaacgggauguggaccuaggugccgggacucgucaugucgccguggagcccgaaguagcgaaccuugauauuaucggacagagaauugagaacaucaagaaugaacacaagucuacguggcacuacgacgaggauaacccuuauaaaacaugggcuuaccauggcaguuaugaggugaagccauccggcagcgcaucauccaugguuaauggggucgugcgccugcucaccaaacccugggacgugauaccuauggucacucaaauugccaugaccgacacaacgccauuuggacagcagaggguuuucaaggaaaaaguggauacccggacucccagagcuaagcgcgguacagcccaaaucauggagguaaccgcaaaguggcuguggggcuuuuugucuaggaacaaaaagccgcgaaucuguacucgggaagaguucacaagaaaagugaggagcaaugccgcuauuggggcggucuuuguggacgaaaaccaguggaauagugccaaggaggcaguugaggaugaacgcuucugggaccuggugcaccgugagcgggaacuccauaaacagggaaagugcgcuaccugcgucuacaacaugaugggcaagagagagaagaaacuuggugaauuugggaaagccaaaggauccagggcaauaugguacauguggcugggcgcccgcuucuuagaguucgaggcucugggcuuuaugaaugaagaucacugguucagccgagagaacucuuugucagggguggaaggagagggucuccauaaacugggcuauauccuacgggacauuaguaagaucccugggggaaauauguacgccgaugacacagcgggcugggauacuagaauuaccgaggacgaucuucagaacgaagcaaaaaucacggacauaauggagccagaacacgcccugcucgcuaccuccaucuuuaagcugacauaucaaaauaagguaguuagggugcagcgccccgccaaaagcgguacugucauggaugugauuucuagacgggaccagagggggucgggacaggugggcaccuacggcuugaacacauucacuaauauggagguccaauuaauccgucagauggaaucagaggggauuuuuagcccuuccgagcuggaaaccccaaaccucgcaaagaaaguucuugacuggcuggagaagcacggagcugaacgacuaaaacgcauggccaucaguggugaugacugugugguaaagcccauagaugacagauucgcuacggcccugacagcacucaacgauaugggcaaggugcggaaagacauuccgcagugggagccuucuaagggguggaaugauuggcagcaaguccccuuuugcagccaucacuuccaucaguugaucaugaaagacggaagggaaaucgugguuccaugucgcaaccaggaugagcuggugggcagagcgcgggucucccagggugccggguggucacuuagggagaccgcuugccugggaaagaguuaugcccaaauguggcagcucauguacuuucaccgacgugacuuaagacuggcagcuaaugccauuuguucugcagugccugccgauuggguacccacuagccgcacaaccugguccauacacgcgcaucaccaguggaugacuaccgaagacauguugucaguuuggaaccggguguggaucgaggaaaauccauggauggaggacaaaacacaugucagcucuugggaagaggugcccuaucugggcaagagggaggaucaauggugcggcucccucauugggcuuacggcuagagccaccugggcaacuaacauccagguugccauuaaucaggugcgccggcugaucggaaacgaaaauuaccuagacuacaugacaaguaugaagagguucaaaaacgagagcgauccugaaggugcucugugguga

SEQ ID NO: 13209 - RNA, 9879 nt, Artificial Sequence
  derived and/or modified CDS sequence (opt3) from DENV-1__KP188568__SS-prME
agcgugaccaugcugcucaugcuucugcccacagccuuggcuuuccacuuaacuacgagaggcggggagccucauaugaucgucuccaagcaagaaagaggaaaaucucuguuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggcaccacaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacuuuggauaucgaacuccugaaaacagaggugaccaacccugcaguccuuagaaagcugugcauugaagccaaaaucuccaauacgaccacagacucuagguguccaacucaaggagaggcuaccuugguugaggaacaagaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuggauuucaacgaaauggugcugcucacaaugaaagaaaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggaucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacuaaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaaucauauucuuuuggaaaacgacaugaaauucaccgucgugguuggcgacgugaaugggauccucgcccagggaaagaaaaugauucggccucaacccauggagcacaaguacuccuggaagucuuggggcaaagcaaagaucauaggggcugauauccagaacacuaccuuuauuaucgacggaccagauacaccugaaugucccgacgaucagcgcgccuggaauauuugggaggucgaggacuauggcuucgguaucuuuacuaccaacauauggcugaaacuaagagauucgcacacacagaugugcgaccauaggcugaugagcgcggccauuaaggauuccaaagcugugcacgcagacaugggguacuggaucgaaucagagaagaaugaaacguggaagcucgcccgugcuaguuucauugagguuaaaaccuguaucuggccaaagucucauacucuguggagcaacggagugcuugaauccgagaugguaauacccaaaaucuauggcgguccuauuucacaacacaauuaccggccaggcuauuucacacagaccgccgggccguggcacuugggaaagcuggaguuagauuuugaccucugcgaaggcacuacagucgugguggaugagcauugcggguaccgaggacccagccugagaaccacgacugucaccggcaaaaucauucacgaaugguguugcaggucuuguacacuuccuccacugcgcuuccggggugaggacgggugcugguacggaauggagaucagacccguuaaggaaaaggaggaaaacuuggugagguccaugguaagugcaggcagcggugagauggacucuuuuucccucggcauacugugugugucaauucuaaucgaagaggucaugcgcagucgauggagccggaaaaugcugaugaccgggacucucgcgguguucuuucugcuuaucaugggacaguugacauggaaugaucugauucguuuaugcaucaugguuggcgccaacgcuucggacagaauggggaugggaaccacauaucucgcccugauggcaacuuucaagaugaggccuauguuugcugugggccuucuguuccgccggcuaaccuccagagagguccuccuguugacggugggucugucuuuaguugccagcguggaacucccaaauucacuggaggaacuuggggauggacuggcaaugggcauuaugauguugaaacuccugacagacuuucaaccccaucagcuauggaccacucugcuuagucucaccuucauaaggacaucccugucuuuggauuacgccuggaagacuauggcuauggcgcugagcaucgucuccuuauuuccgcucugucugucaaccacgagccagaaaacaaccuggcuuccuguacuguugggcaguuucgggugcaagccacucacuauguuucugauuacagagaacaagaucuggggacgaaaaucuuggcccauuaacgaagguaucauggccgugggcauaguuuccauccuacugagcucgcuucucaagaaugacgugccucuggcagggcccuugauugcuggaggcauguuaaucgccuguuaugucauuucagguucuagugccgaucugucccucgagaaagcugcagaggugagcugggaagaggaagccgagcacucugggaccagccauaacauccugguagaagugcaggacgauggaacuaugaagauaaaagacgaggagcgcgaugacacacuuaccauucuguugaaggcgacgcuacuggcugucuccggcguuuacccaaugucaaucccugccacucucuucgugugguauuucuggcagaaaaagaagcagcggaguggcgugcugugggauacccccagcccaccggaagucgagagagcagugcuugacgacgggaucuacaggauuuuacagcguggacugcucggucgcucucagguuggcguagggguguuucaagauggagucuuccacacaauguggcacgugacccggggcgccguuuugauguaucaggguaaaagacuggaaccuuccugggcuucagugaagaaagaccucauaaguuacgggggaggcuggagguuucagggcagcuggaauacaggggaggagguccaggugaucgcaguagaacccggaaagaaccccaaaaauguccaaacuacccccgguacguucaagacaccugagggcgaagugggggccauugcgcuggauuuuaagccaggaacuuccggcucucccaucguuaaccgagaggguaaaauuguggggcuuuacggaaauggcgucgugaccacaucgggcaccuauguuagcgcuaucgcccaggcaaaggccacucaggaagggccucugccggagauagaggacgaaguguucaaaaagcggaacuugaccaucauggaucuacauccaggaucagguaaaacacgcagauaccugcccuccauugucagggaggcuaucaagcggaagcuccgaacguuaauucuggccccuacuagagugguagcaagugaaauggcugaggcccuuaaaggcaugccaauccgcuaucaaaccacagcggugaagucugaacacaccgggagggagauaguugaccugaugugccaugccacuuuuacaaugcgucucuugagccccguccgggugccuaauuacaacaugauuaucauggaugaggcacacuucaccgacccggcuuccaucgccgcuagaggauauauuucaacgagggugggcaugggugaagcagccgccaucuuuaugacugcuacacccccagggucugucgaggcguucccucagagcaaugcagccauacaggaugaggaacgcgacauucccgaacgaaguuggaacaccggauacgauuggaucaccgacuuuccaggcaaaacuguaugguucgugccuuccauuaagagcggcaaugacaucgcuaacugucugaggaaaaaugggaagcggguuauacagcucucuaggaagacauucgauaccgaguaucagaaaacaaagaacaacgacugggauuacguggucacuacggacauuucagagaugggagccaauuuucgcgcagaucgugugaucgaccccagacggugccugaaaccaguuauccuuaaggaagguccggagagggugauucuagccggcccuaugcccgucaccguggcuuccgcggcccagcgccgagggagaaucggacggaaccagaauaaagaaggcgaucaguacauuuauaugggucaaccacugaacaaugacgaggaucaugcacacuggacagaggcuaagauguuguuagacaacauaaauacucccgaagggaucauuccugcccuguucgagccagaaagggagaagagugcagccaucgauggcgaauaccgccucagaggagaggcuaggaaaaccuuuguagagcugaugcggcguggcgaccuucccguguggcugagcuauaagguugccucggaaggguuccaguacucugaucgccgauggugcuuugacggagagagaaacaaucagguccucgaagagaacauggacguggaaaucuggacaaaagagggugagaggaagaaauugcggccucgcuggcuggaugcgagaaccuauuccgacccgcuagcacugagggaguucaaggaguuugccgcuggccggcgaagcgugucaggggaucucauucuugaaauaggaaaacugccacagcacuuaacuuugagagcccaaaaugcucuggacaaccucgucaugcugcauaauagugagcagggcgguaaggcauaccgccacgccauggaggaacuucccgauacgaucgagacccugaugcucuuggcucugauugccguuuuaacagggggcgugacucuauucuuucugucuggaaagggccucgggaaaaccuccaucggacuucuguguguaauggcaagcucagcguugcuguggguggccagugucgaaccucauuggauugcugccagcaucauacucgaguucuuucugauggugcuucucauccccgaaccagacaggcagcggacaccucaggauaaccaacuggcauauguugugauugguuugcuguucaugaucuuaaccgucgcugccaaugagaugggccuacuggagacuacaaagaaagaccucgggauuggacacguagcaguggaaaaccaccaucacgccacgaugcuugauguugaccugcgucccgcuuccgcguggaccuuguacgccguggcaacuacagucaucaccccaaugaugagacauaccauagagaacacaacugcuaauauuucucugacggccaucgccaaccaggcagcuauucucaugggccuggauaaggguuggccuaucagcaaaauggacauaggggugccgcuuuuagcccugggcugcuacucccaggucaauccccucaccuugacagcggcugugcugaugcuaguugcccacuaugcaaucauuggaccaggccugcaagccaaggcuacuagggaagcacagaagcgcaccgccgcggggaucaugaaaaacccuacaguggauggaauuguaaccaucgaccucgaccccguggucuacgaugcuaaguuugagaaacagcuuggccagauaaugcuguugauucuguguacuucacaaauccuccugaugcggacgacaugggccuuaugcgaaucuaucacccuugcaacugguccacugaccacacucugggaggggaguccuggaaaguucuggaauacuaccauugccguuucgauggcuaacaucuuccgaggcagcuaucuagccggugcaggccuggcuuuuuccgugaugaaaucucuagggggcggcagaagggggacaggagcccagggcgagacgcugggugaaaaguggaagcgccagcucaaucagcuuucaaaaagcgaguucaacaccuacaagaaauccgggauaauggaagucgaccggagugaggcgaaggaaggacugaaaagaggcgagacuacaaagcaugccgugucucgugguaccgcaaaguugaggugguuuguagagcggaaucuggugaaacccgaaggcaagguuauugaucucggguguggacgcggcggguggagcuauuacugcgcuggacugaaaaaggugacugaggucaaaggcuauacaaagggugggccgggacacgaggaaccaaucccuauggccaccuacggcuggaaccuagugaaacuucacucaggcaaggacgucuucuuuacgcccccagaaaagugugauacccugcuaugcgacauuggggaguccagucccaauccuacaaucgaggaaggacgaacucucagagugcugaaaaugguugagccgugguugagggguaaccaauucuguauaaagauccugaaucccuacaugccaagcguaguggaaacccucgagcagaugcagcggaaacauggcgggaugcuuguccgcaacccucugucuagaaauuccacacacgagauguauugggugucaugcggaacuggcaacauuguuagcgcagugaauaugaccucgaggauguuacugaaccgauuuacaauggcucaucggaagcccaccuacgaacgugaugucgacuugggugccgggacuagacacguggccguagagccugaaguggcgaaccucgauaucauuggacagcgcaucgagaauauuaaaaacgaacacaagucuacguggcauuaugacgaggauaauccauacaagacaugggcuuaucacggcaguuacgagguuaaacccuccggcagcgcaucauccauggucaacgggguggugaggcugcuaaccaagccuugggacgucaucccaaugguuacucaaauagccaugaccgacacaacgcccuucggacagcagcggguguuuaaagaaaagguagauaccagaacuccgcgcgcuaaaagggguacagcccaaauuauggaggugaccgcaaaguggcuuuggggcuuccugucucgaaauaagaaaccucggaucuguacuagagaagaguuuacaaggaagguccgcagcaacgccgcuaucggggcgguguucguugacgaaaaucaguggaacagugccaaagaggcaguggaggaugaacguuuuugggaccucguccaucgggagagagaacugcacaagcagggaaaaugcgcuaccugcguguauaauaugaugggcaagagggagaagaaauugggugaguucgggaaggccaaaggaucccgcgcaauuugguacauguggcugggcgcccgauuccucgaguuugaggcucuuggcuucaugaacgaagaucauugguuuagccgggaaaauucucugucagggguagaaggagaggguuuacacaagcugggcuacauauugagagacaucaguaaaauuccagggggaaacauguaugccgaugacacagcgggcugggauacuaggaucaccgaggacgaucuccagaaugaagcaaagauuacggacaucauggagcccgaacacgcccugcuagcuaccuccauauucaaacuuacauaccaaaacaagguugugcgcguccagagaccugccaagagcgguacugugauggaugugaucucucggagggaccagcgugggucgggacaggucggcaccuauggccugaauacauuuacuaacauggagguucaacucauucgacagauggaaucagaggggaucuucagcccauccgagcuggaaacccccaacuuggccaaaaagguguuagacuggcuggagaaacauggagcugaacgccucaagagaauggccauuaguggugaugacuguguagugaaaccgaucgaugaccgguuugcuacggcccuuacagcacugaaugauaugggcaaggucaggaaggacauaccucagugggagcccucuaaaggguggaacgauuggcagcaagugccauucugcagccaccauuuucaccagcuaauuaugaaggacggacgcgaaaucguugugccuuguagaaaucaggaugagcuggucggccgggcgagggugucccagggugccggguggucacuccgagagaccgcuugcuugggaaaaaguuacgcccaaauguggcagcugauguauuuccaccguagagaccuucgccuggcagcuaacgccaucuguucugcaguacccguugauugggugccaacuagccggacaaccugguccauucaugcccaccaucaguggaugacuaccgaagacaugcucucagucuggaauaggguguggauagaggaaaaccccuggauggaggacaagacacacguuagcucuugggaagaggugccuuacuuaggcaaaagagaggaucaauggugcggcucccugaucggguugacggcgcgcgcuaccugggccacuaauauucaggucgcaaucaaccaggugcggaggcugauuggaaaugaaaacuaucucgacuacaugacaaguaugaagcgauuuaagaaugagagcgauccagaaggugcccuuugguga

SEQ ID NO: 13210 - RNA, 9879 nt, Artificial Sequence
  derived and/or modified CDS sequence (opt3) from DENV-1__KF971870__SS-prME
agcgugacaaugcugcucaugcuuaugcccacagcacuggcuuuccacuugacuacgagaggaggggaaccucauaugauggucuccaagcaggaaaggggaaaaucuuuacuguuuaagaccucagccgguguuaacaugugcacacuaaucgccauggaccucggagaacugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauacagaggguggaaacuugggcucuccggcacccuggauucaccguuaucgcacuguuucuggcccaugcuauuggcacaucgaucacccagaagggcauuaucuucauacucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaacuacucaagacagaggugaccaacccugccgugcugaggaaacuuugcaucgaagcuaagauuucuaauacgaccacagauagccgguguccaacucaaggagaggccacccuggucgaagaacaggacgcaaacuucguuugccgccgaacauuuguggauagaggcugggguaauggguguggauuguucggcaaaggcucccucaucacuugcgcuaaguuuaagugcguaaccaaacuggaggggaagauagugcaguacgaaaacuuaaaauauucagucauugugacaguucacaccggagaccagcaucaaguggguaaugagaguacugaacacggcacgacagccaccaucacuccccaggcgccuaccacagagauucagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccaucuuugccggccauuuaaaaugccgucugaagauggauaaacuaacacucaaggggauguccuaugugauguguacuggcagcuucaaacuggagaaggaagucgcugagacccagcacgguacggugcuuguucagauuaaguacgagggcacagacgcgccuugcaaaauaccauucucgacccaagaugaaaagggggugacucagaacggacgcuugaucacagcaaaucccauuguaaccgacaaagagaagccugucaacaucgaagccgagccacccuuuggcgagucuuauauagugauuggugcuggggaaaaagcccugaagcucuccugguucaagaaaggcucaaguaucggaaagauguuugaggcaacugccagaggcgcuaggcggauggccauccugggggauaccgcaugggacuucggaagcauugguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguugcugggauccuggcccagggcaaaaagaugauucgcccucaacccauggaguacaaauauucguggaaaagcuggggcaaggcgaagaucauaggggccgacgugcagaauacuaccuuuaucauugauggaccaaacacaccugaaugucccgacgaucagagagcuuggaauaucugggaggucgaggacuacggcuucgguauuuuuacuaccaacaucuggcuuaaguugagggauuccuauacacaggugugcgaccaccgucucaugucaagugcaauaaaagauucuaaggccguucacgcugacaugggguacuggauugaaagcgagaaaaaugauacguggaagcuggcccgggcauccuucaucgaagugaagaccuguauuuggccaaaaucacauacucuauggagcaacggaguacuggagucugaaaugaucauacccaagaucuauggcgguccuauuucccaacacaauuaccgaccaggcuacuucacacagaccgcggggccguggcaucucggaaaacuggagcuugacuuugauuugugcgagggcacuacagucgugguggacgaacacugcgggaacagaggacccagucugaggaccacgacugucaccggcaagaucauucacgagugguguugccgcagcuguacauuaccuccacuccgguucagaggugaagacgggugcugguauggaauggagaucaggcccguuaaagagaaggaagagaaucuggugaagucuaugguauccgccggcucaggugaaguggauaguuuuagccuuggccuguuguguauaucgauuaugaucgaggaagucaugcgcucccgauggucucggaaaaugcucaugaucgggacccuggcuguguucuuucuacugauuaugggacagcucacuuggaacgaccugauccgucuuugcauuaugguuggcgccaaugcaagcgauagaauggggaugggaacaaccuacuuggcucugauggccacauucaagaugaggccuauguuugcagugggcuuacucuuccgccggcugacuucaagagagguccuucugcuaaccauaggucucagucugguggccuccgcugaguugccaaacucucuggaagaguuaggggacggacucgcgaugggcaucaugauucugaaacuucugacggauuuucaaagccaucaguugugggccacacuccugucccuaaccuucaucaagacuaccuuuucacugcacuaugcauggaaaacaauggcuaugguucuuagcauugugagucucuucccccuguguuugucuacuaccucccagaagacgacauggcugccggucuuacucggcagccuggggugcaagccucuuaccauguuucugaucgccgaaaauaaaauauggggaaggaagucguggccauugaacgaggguaucauggccguaggcauugugucaauccuccugucuagucuacugaaaaacgacguuccccuugcugggccucucauugcaggaggcaugcugaucgccuguuacgugauauccgguagcucugcggauuugagcuuagaaaaggcugccgaggucuccugggaggaagaggcagaacauucaggggccagucacaauauucugguggagguacaggacgauggaacuaugaaaaucaaggacgaagaacgagaugacacacucaccauccugcuuaaagcuacucuguuggcagugagcggcgucuucccccuaucuauuccagccacacuguucguuugguauuuuuggcaaaagaagaaacagcgcuccggcgugcucugggauaccccuucacccccagagguggaacgggcgguccuggacgacgggauauacagaaucaugcagaggggacuuuuaggucguagucaggugggcguugggguauuccaagagaacguguuucauacgauguggcacgucacucgcggagcugugcugauguaucagggcaagcggcucgaaccgagcugggccuccguuaaaaaggauuugauuucuuacggugggggauggagacugcagggcucguggaauaccggcgaggaggugcaggucaucgcaguggaaccugggaaaaaccccaagaauguacaaacagccccaggaaccuucaagacacccgagggugaagucggcgcuauugcccucgacuuuaaaccugggacuagcggaucaccaaucgugaacagggagggcaagauaguuggucuguacgggaauggaguggucaccacguccggcacauaugugagugcaaucgcucaggccaaagcgucucaggaaggcccccuuccugagauugaggaugaaguuuuccgaaagcggaaccugacuaucauggacuugcacccggggagcggaaaaacccgcagauaccuaccagccauugugagggaggcaaucaagcggaagcugcgaacacucauauuagcucccaccagagucguggccuccgaaauggcugaggcacugaaagguaugccuauucgcuaucaaacuaccgccguaaagucagaacauacaggcaaagagaucguggaucuuaugugccacgccacguuuacuaugaggcugcucucuccaguucguguccccaauuacaacaugaucauuauggacgaggcucauuucaccgauccuagcaguaucgcggcacggggguauauauccacaagagugggaaugggcgaagccgcugccauuuuuaugaccgcaacuccgcccgguagcguggaggccuucccacagucuaaugcugucauccaggacgaagagagggauauuccugaacgcucauggaacuccggguacgaguggaucacagacuuucccggaaagaccguaugguucgugccaaguauaaaaagcggcaaugauauugcgaacuguuugcgaaagaauggcaagagaguuauccagcugucgcggaaaacguucgacacugaguaucaaaagaccaaaaacaacgacugggauuacguggucaccaccgacaucucugaaaugggggccaauuuuagggcagaucgcgugauugacccucguagaugccucaagcccguuauccugaaagauggaccagagcgggugauucuugcugguccgaugccugucacuguggccuccgcagcccagaggcgcggccgaauagggagaaaccacaauaaggaaggagaccaguacaucuauaugggccagccccuaaacaaugaugaggaccaugcucacuggacagaggccaagaugcuguuggauaacauuaauaccccagaagguaucauccccgcguuauucgagccugaacgggagaaaagcgcagccauugacggggaauacaggcugcgcggcgaggcuagaaagacauuuguagagcucaugaggcggggagaucugccaguguggcuuucauauaaaguugccagugaaggcuuccaauacucugaccgucgcuggugcuuugauggggagcgaaacaaucagguccuggaagagaacauggacguggaaauauggacuaaggagggagagagagaaaaacucaggccccggugguugggugcucgcacguauuccgacccucuggcacuaagagauuucaaggaguuugccgcuggcaggcggagcgugucaggggaccugauccucgaaauuggaaaacuuccgcagcaccugacccagcgagcccaaaaugcauuagauaacuuggucaugcugcauaauagucagcagggcgguagagcguacacacacgccauggaggaacucccagacacuaucgagacccugaugcuucuggcucucauugccguuuugacagggggcgugacccuguucuuuuuaagcggacgcggccuagggaagacuuccaucggacugcucuguguaauggcaucuagcgugcuucuguggauggcuuccgucgagccccauuggauagccgcaucaaucauuuuggaguucuuucugauggugcuccugaucccugagcccgauaggcagcggacgccacaagacaaccagcuugccuauguugugauuggucuccuguucaugaucuugaccgucgcugcgaaugaaaugggccuguuagagacaacuaagaaagaucuagggauaggacacguagccguggagaaccaccaucacgcagcuaugcuggacguugaucuccauccugccucugccuggacccuuuacgcaguggcuacaaccauuaucacucccaugaugcgucacacaauugaaaacacgaccgccaauaucagucugacugcgauagcuaaccaggccgcaaucuugaugggccuggacaaggguuggccaauuucgaaaauggauaucggggucccucuccuggcccuuggcugcuacagccaagugaauccguuaacacugaccgcugcaguccucauguugguggcccauuaugcgauuaucggacccggccugcaggcuaaggccaccagagaggcacagaaaaggacagccgcugggauaaugaagaacccaacuguugacggaauuguggccaucgaucuagacccuguaguguacgacgcaaaguuugaaaaacagcugggccaaaucaugcuccuuauucuguguacgucccagaucuugcugaugcgcaccacaugggcucucugcgagucuauaacucuggccaccggucccuuaacaacccuuugggaagggucaccaggaaaguucuggaauacuacgauugcggucagcauggccaacaucuuccggggcuccuaucuggcaggagcuggccucgccuuuagucuaaugaaaucucuaggggguggccgaagagggacaggagcacagggcgagaccuugggugagaaguggaaaaggcgccugaaucagcucagcaagucagaguucaacacuuacaagcgguccgggauuauggagguugauagaagugaagcuaaagagggacuuaagcguggcgaaaccacaaaacacgccgugagcagggguacugccaagcugcggugguuugucgagcgcaauuuggugaaaccugagggcaagguaaucgaccugggguguggacgaggcggguggucuuauuacugcgcgggacucaagaaagugaccgaaguuaagggcuauacaaaaggugggcccggacacgaggaaccgauaccaauggcuacguacggcuggaacuuagugaagcugcauuccggcaaagaugucuucuuuaucccucccgagaagugugacacccuucugugcgauauuggggaaucaagcccaaaucccacuaucgaggagggaagaacacuaagggugcucaaaauggucgaaccuuggcugcgggguaaccaauucuguauuaagaucuugaauccguacaugcccucggugguugagacccuggaacagaugcagcgcaagcacggcgggaugcucguaagaaacccacuuucuaggaauaguacucaugagauguauuggguguccugcggaacaggcaacauugucagcgcagugaauaugaccucacgaaugcuguuaaaccgguuuacgauggcccaccguaaaccuaccuacgagagagacguugaucugggugcugggacacgccacguggccgucgaacccgagguggcaaacuuggacaucauaggacagaggauugaaaauaucaagcaugagcacaaauccacuuggcauuaugaugaagacaacccuuacaagaccugggccuaucacggcucuuacgagguaaaaccaagcggcagugcuuccagcauggugaaugggguugucaagcuccugacaaagcccugggaugugaucccuauggugacucaaauugcgaugaccgacacaaccccauucggacagcagcgggucuuuaaagagaagguugacacuagaacgcccaaagccaagcgcgguacagcacaaauaauggaagugaccgcuagguggcuauggggcuuccuuucucgaaacaaaaagccgcggaucuguacuagagaggaauuuaccaggaagguacgcucaaaugccgcaauuggggccguguucaucgaugagaaccaguggaauagugcuaaagaagccgucgaggacgagcguuuuugggaucuggugcaucgggaaagagagcuccacaagcagggaaaaugcgcgacaugcguuuauaacaugaugggcaagagggagaaaaagcugggugaguucgggaaggcaaaaggaucccgcgccauuugguacaugugguugggcgcucgauuccuggaauuugaggcccucggcuucaugaaugaggaccacugguuuagccgggaaaacucucuuucggggguggagggagaaggucugcauaaguuaggcuacauccugagagauauaucaaaaaucccugggggaaauauguaugcagacgauacggcuggcugggacaccaggauuacugaggaugacuugcagaacgaggccaagaucacagauauuauggaaccagagcacgcucuccuggccaaagcaaucuucaagcuaaccuaccaaaauaaagucgugcgcguacagagacccgcgaagaacgguacuguuauggacgugauaagccggagggaucagcguggguccggacaggucggcacauauggccuuaauaccuuuacaaacauggaagcccaacugauucgacagauggagagugaagggaucuucucuccuagcgagcucgagacuccaaaccuggcugaacgcguguuggacugguuaggaaaguacgguguggagagacugaaacggauggccaucuccggcgacgauugugucguuaagcccauugacgauagguuugcaaccgcucucacggcccuuaaugacauggggaaagugcgcaaggauauaccgcagugggaaccuucaaaaggauggaacgacuggcagcaaguacccuucugcagucaucacuuucaccagcugaucaugaaggauggcagagagauuguggucccaugucggaaucaggacgagcugguggguagggcacgaguuucucagggggccggauggagccugcgugagaccgcgugccucggcaaguccuaugcucaaauguggcaguugauguacuuccauagacgcgaucugcggcuugccgcaaacgccaucuguucagcugugccugucgacugggugcccacaagcaggacuaccuggucuauucacgcccaucaccaguggaugacaacugaggauaugcuguccguauggaauagaguuuggaucgaagagaacccauggauggaagacaaaacccauauaaguaauugggaggacgugcccuaucucggcaagcgcgaagaucaauggugcgggagcuuaaucggacugacggcacgggcuacaugggccaccaacauucaggucgcgaucaaucaggugaggcgauugauugguaacgagaauuaccuggacuacaugacuucgaugaaaagauuuaagaacgaguccgauccugaaggcgcucucugguga

SEQ ID NO: 13211 - RNA, 9879 nt, Artificial Sequence
  derived and/or modified CDS sequence (opt3) from DENV-1__KF971871__SS-prME
agcgugacaaugcugcucaugcuuaugcccacagcacuggcuuuccacuugacuacgagaggaggggagccucauaugauggucuccaagcaggaaaggggaaaaucuuuacuguuuaagacaucagccgguguuaacaugugcacacugaucgccauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauacagaggguggaaacuugggcucuccggcacccuggauucaccguuaucgcacuguuucuggcccaugcuauuggcacaucgaucacccagaagggcauuaucuucauacucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaacuacucaagacagaggugaccaacccugccgugcugaggaaacuuugcaucgaagcuaagauuucuaauacgaccacagauagccgguguccaacucaaggagaggccacccuggucgaagaacaggacgcaaacuucguuugccgccgaacauuuguggauagaggcugggguaauggguguggauuguucggcaaaggcucccucaucacuugcgcuaaguuuaagugcguaaccaaacuggaggggaagauagugcaguacgaaaacuuaaaauauucagucauugugacaguucacaccggagaccagcaucaaguggguaaugagaguacugaacacggcacgacagccaccaucacuccccaggcgccuaccacagagauucagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccaucuuugccggccauuuaaaaugccgucugaagauggauaaacuaacacucaaggggauguccuaugugauguguacuggaucguucaaacuggagaaggaagucgcugagacccagcacgguacggugcuuguucagauuaaguacgagggcacagacgcgccuugcaaaauaccauucucgacccaagaugaaaagggggugacucagaacggacgcuugaucacagcaaaucccauuguaaccgacaaagagaagccugucaacaucgaagccgagccacccuuuggcgagucuuauauagugauuggugcuggggaaaaagcccugaagcucuccugguucaagaaaggcucaaguaucggaaagauguuugaggcaacugccagaggcgcuaggcggauggccauccugggggauaccgcaugggacuucggaagcauugguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguugcugggauccuggcccagggcaagaagaugauucgcccucaacccauggaguacaaauauucguggaaaagcuggggcaaggcgaagaucauaggggccgacgugcagaauacuaccuuuaucauugauggaccaaacacaccugaaugucccgacgaucagagagcuuggaauaucugggaggucgaggacuacggcuucgguauuuuuacuaccaacaucuggcuuaaguugagggauuccuauacacaggugugcgaccaccgucucaugucagcagccauaaaagauaguaaggcuguucacgccgacaugggguacuggauugaaucugagaaaaaugauacguggaagcuggcacgggcgagcuucaucgaagugaagaccuguauuuggccaaaaucccauacucuauggucaaacggaguacuggagagcgaaaugaucauacccaagaucuauggcgguccuauuucucaacacaauuaccgaccaggcuacuucacacagaccgccgggccguggcaucucggaaaacuggagcuugacuuugauuugugcgagggcacuacagucgugguggacgaacacugcgggaacagaggacccucccugaggaccacgacugucaccggcaagaucauucacgagugguguugccgcaguuguacauuaccuccacuccgguucagaggugaagacgggugcugguauggaauggagaucaggcccguuaaagagaaggaagagaaucuggugaaguccaugguaucugcuggcuccggugaaguggauucauuuagucuuggccuguuguguauaagcauuaugaucgaggaagucaugcgcucgcgauggucccggaaaaugcucaugaucgggacccuggccguguucuuucuacugauuaugggacagcucacuuggaacgaccugauccgucuuugcauuaugguuggcgcaaaugcuucugauagaauggggaugggaacaaccuacuuggcccugauggcaacauucaagaugaggccuauguuugccgugggcuuacucuuccgccggcugacuagcagagagguccuucugcuaaccauaggucucucacugguggcuagugcggaguugccaaacucccuggaagaguuaggggacggacucgccaugggcaucaugauucugaaacuucugacggauuuucaaucucaucaguugugggcaacacuccugagccuaaccuucaucaagacuaccuuuucccugcacuaugcuuggaaaacaauggccaugguucuuucaauugugagccucuucccccuguguuugaguacuaccucucagaagacgacauggcugccggucuuacucggcucccuggggugcaagccucuuaccauguuucugaucgccgaaaauaaaauauggggaagaaagagcuggccauugaacgaggguaucauggcuguaggcauugugucgauccuccugucaucucuacugaaaaacgacguuccccuugcagggccucucauugccggaggcaugcugaucgcguguuacgugauaagugguuccagcgcugauuugucuuuagaaaaggccgcagaggucagcugggaggaagaggccgaacauuccggggcuucacacaauauucugguggagguacaggacgauggaacuaugaaaaucaaggacgaagaacgagaugacacacucaccauccugcuuaaagcaacucuguuggccgugaguggcgucuucccccuaagcauuccagcgacacuguucguuugguauuuuuggcaaaagaagaaacagcgcucuggcgugcucugggauaccccuucacccccagagguggaacgggcuguccuggacgacgggauauacagaaucaugcagaggggacuuuuaggucguagccaggugggcguugggguauuccaagagaacguguuucauacgauguggcacgucacucgcggagccgugcugauguaucagggcaagcggcucgaaccgaguugggcaagcguuaaaaaggauuugauuuccuacggugggggauggagacugcagggcucuuggaauaccggcgaggaggugcaggucaucgccguggaaccugggaaaaaccccaagaauguacaaacagcuccaggaaccuucaagacacccgagggugaagucggcgccauugcacucgacuuuaaaccugggacuucgggaagcccaaucgugaacagggagggcaagauaguuggucuguacgggaauggaguggucaccacgucaggcacauauguguccgcuaucgcccaggcgaaagccagucaggaaggcccccuuccugagauugaggaugaaguuuuccgaaagcggaaccugacuaucauggacuugcacccggggucuggaaaaacccgcagauaccuaccagcaauugugagggaggcuaucaagcggaagcugcgaacacucauauuagcccccaccagagucguggcuagcgaaauggcagaggcccugaaagguaugccuauucgcuaucaaacuaccgccguaaaguccgaacauacaggcaaagagaucguggaucuuaugugccacgcuacguuuacuaugaggcugcucucaccaguucguguccccaauuacaacaugaucauuauggacgaggcgcauuucaccgauccuucuagcaucgcagcccggggguauauaaguacaagagugggaaugggcgaagcugccgcaauuuuuaugaccgccacuccgcccgguuccguggaggcuuucccacagagcaaugcggucauccaggacgaagagagggauauuccugaacgcucuuggaacucaggguacgaguggaucacagacuuucccggaaagaccguaugguucgugccauccauaaaaaguggcaaugauauugccaacuguuugcgaaagaauggcaagagaguuauccagcugagccggaaaacguucgacacugaguaucaaaagaccaaaaauaacgacugggauuacguggucaccaccgacaucucggaaaugggggcaaauuuuagggcugaucgcgugauugacccucguagaugccucaagcccguuauccugaaagauggaccagagcgggugauucuugccgguccgaugccugucacuguggcaucugccgcucagaggcgcggccgaauagggagaaaccacaauaaggaaggagaccaguacaucuauaugggccagccccuaaacaaugaugaggaccaugcccacuggacagaggcgaagaugcuguuggauaacauuaauaccccagaagguaucauccccgcauuauucgagccugaacgggagaaauccgccgcuauugacggggaauacaggcugcgcggcgaggccagaaagacauuuguagagcucaugaggcggggagaucugccaguguggcuuagcuauaaaguugcuucagaaggcuuccaauacagugaccgucgcuggugcuuugauggggagcgaaacaaucagguccuggaagagaacauggacguggaaauauggacuaaggagggagagaggaaaaagcucaggccccggugguugggugcacgcacguauucugacccucuggcccuaagagaguucaaagaguuugcugccggcaggcgguccgugagcggggaucugauccucgaaauuggaaaacuuccgcagcaccugacccagcgagcacaaaaugcguuagacaacuuggucaugcugcauaauucagagcagggcgguagagccuaccgccacgcuauggaggaacucccagauacaaucgagacucugaugcuucuggcccucauugcaguuuugaccgggggcgugacacuguucuuuuuaaguggaaggggccuagggaagaccagcaucggacugcucuguguaauggcuuccucugugcuucuguggauggccagcgucgaaccccauuggauagcagccuccaucauuuuggaguucuuucugauggugcuccugaucccugaacccgaccggcagcguacuccacaggauaaccaacuugcuuauguugugauuggucuccuguucaugaucuugacggucgcggccaaugagaugggccuguuagagaccaccaaaaaggaccuagggauaggacacguagcaguggaaaaccaccaucacgcugccaugcuggauguugaccuccauccugccucagcauggacucuuuacgcuguggccaccacaauuaucacccccaugaugagacacacuauugagaacacaacggcgaauaucucucugaccgcuauagccaaccaggcagccaucuugaugggccuggauaaagguuggccaauuaguaagauggacaucggggucccucuccuggcucuuggcugcuacagccaggugaauccguuaacucugacagcagccguccucauguugguggcgcauuaugcuauuaucggacccggccugcaagccaaagcaaccagggaagcccagaagcgcaccgcugccgggauaaugaagaacccaacaguugauggaauuguggcaaucgaccuagauccuguaguguacgacgcuaaauuugagaagcagcugggccagaucaugcuccuuauucuguguacuagccaaaucuugcugaugcggacgaccugggcccucugcgaauccauaacacuggcgacuggucccuuaaccacacuuugggaggggucuccaggaaaauucuggaauaccacuauugccgucucaauggcaaacaucuuccgaggcagcuaucuggcuggugccggccucgcauuuucccuaaugaagagucuagggggaggcagaagggggacgggagcucagggcgagacauugggugaaaaauggaagcgccggcugaaucagcucucuaagagcgaguucaacaccuacaaaagaucagggauuauggaaguugaccguuccgaggccaaggaaggacuuaaaaggggcgagacuaccaagcacgccgugagucgggguacagcgaaacugcgcugguuugucgagcgaaauuuggugaagccugaaggcaagguaaucgaucugggguguggaagaggcggguggagcuauuacugcgcuggacucaaaaaggugacugagguuaaaggcuauaccaagggugggcccggacacgaggaaccgauaccaauggcaacauacggcuggaacuuagugaaacugcauucuggcaaggacgucuucuuuaucccucccgaaaaaugugauacgcuucugugcgacauuggggaguccucaccaaaucccaccaucgaggaaggaaggacucuacgggugcucaagauggucgagccuuggcugcgcgguaaccaguucuguauuaagaucuugaauccguacaugcccagcgugguugaaacacuggagcaaaugcagagaaaacacggcgggaugcucguaaggaacccacuuucgcgaaauucuacccaugagauguauugggugaguugcggaacuggcaacauugucuccgccgugaauaugacaagccggaugcuguuaaaccguuuuaccauggcucacagaaagccuacguacgaacgcgauguugaccugggugccgggaccaggcacguggcagucgagcccgaaguggccaacuuggauaucauaggacagcggauugagaauaucaaacaugaacacaagucaacauggcauuaugacgaggauaacccuuacaaaacuugggcuuaucacggcuccuacgagguaaagccaucuggcagcgcgaguuccauggugaaugggguugucaagcuccugaccaaacccugggacgugaucccuauggugacacagauugccaugacugauaccacaccauucggacaacagagagucuuuaaggaaaaaguugacacccgcacucccaaggcaaaaagggguacggcucagauaauggaggugacagcccgauggcuauggggcuuccuuagccggaacaagaagccgagaaucuguaccagggaagaguuuacucgcaaaguacguucuaaugcagccauuggggcuguguucaucgacgaaaaccaauggaacucagccaaggaggcggucgaggaugaacgguuuugggaccuggugcauagagagagggaacuccacaaacagggaaagugcgcaaccugcguuuauaacaugaugggcaaacgcgagaagaagcugggugaguucgggaaagccaagggaagucgagcuauuugguacaugugguugggcgcccgguuccuggaguuugaggcacucggcuucaugaaugaagaucacugguuuuccagagagaacagccuuucugggguggaaggagagggucugcauaaauuaggcuacauccugagggacauaucgaagaucccugggggaaauauguaugcugaugacacagccggcugggauacgcgcauuaccgaggacgauuugcagaacgaagcuaaaaucacugacauuauggagccagaacacgcccuccuggcaaaggcgaucuucaaacuaacauaccagaauaaggucgugagaguacaacggcccgccaagaacgguaccguuauggaugugauaucaaggcgugaccagcgagggagcggacaggucggcacuuauggccuuaauacauuuaccaacauggaggcucagcugauucgccaaauggaauccgaggggaucuucaguccuucugagcucgaaacaccaaaccuggccgagagaguguuggauugguuaggaaaauacgguguggaacggcugaagaggauggcaaucagcggcgacgacugugucguuaaacccauugaugaccgcuuugcuacugcccucaccgcacuuaaugauauggggaaggugagaaaagacauaccgcagugggagccuuccaagggauggaacgauuggcagcagguacccuucugcucacaucacuuucaccaacugaucaugaaggacggccgggaaauuguggucccauguaggaaucaggaugagcuagugggucgagcccguguuagucagggggcgggauggucucugagagagacggcuugccucggcaaaagcuaugcccagauguggcaauugauguacuuccaucgccgggaccugaggcuugcagccaacgcuaucuguuccgccgugccugucgauugggugcccaccucaagaacaacuuggagcauucacgcacaucaccaguggaugaccacagaagacaugcugucuguauggaaucgcguuuggaucgaggaaaacccauggauggaggauaagacucauauauccaauugggaagacgugcccuaucucggcaaacgggaggaccaguggugcgggaguuuaaucggacugaccgcuagggccacgugggcgacaaacauucaagucgcuaucaaucaggugcgaagauugauugguaacgagaauuaccuggauuacaugaccagcaugaagcgguuuaaaaacgaaucggacccugagggcgcccucugguga

SEQ ID NO: 13212 - RNA, 9879 nt, Artificial Sequence
  derived and/or modified CDS sequence (opt3) from DENV-1__KF971869__SS-prME
agcgugacaaugcugcucaugcuuaugcccacagcacuggcuuuccacuugacuacgagaggaggggagccucauaugauggucuccaagcaggaaaggggaaaaucuuuacuguuuaagacaucagccgguguuaacaugugcacacuaaucgccauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauacagaggguggaaacuugggcucuccggcacccuggauucaccguuaucgcacuguuucuggcccaugcuauuggcacaucgaucacccagaagggcauuaucuucauacucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaacuacucaagacagaggugaccaacccugccgugcugaggaaacuuugcaucgaagcuaagauuucuaauacgaccacagauagccgguguccaacucaaggagaggccacccuggucgaagaacaggacgcaaacuucguuugccgccgaacauuuguggauagaggcugggguaauggguguggauuguucggcaaaggcucccucaucacuugcgcuaaguuuaagugcguaaccaaacuggaggggaagauagugcaguacgaaaacuuaaaauauucagucauugugacaguucacaccggagaccagcaucaaguggguaaugagaguacugaacacggcacgacagccaccaucacuccccaggcgccuaccacagagauucagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccaucuuugccggccauuuaaaaugccgucugaagauggauaaacuaacacucaaggggauguccuaugugauguguacuggaucguucaaacuggagaaggaagucgcugagacccagcacgguacggugcuuguucagauuaaguacgagggcacagacgcgccuugcaaaauaccauucucgacccaagaugaaaagggggugacucagaacggacgcuugaucacagcaaaucccauuguaaccgacaaagagaagccugucaacaucgaagccgagccacccuuuggcgagucuuauauagugauuggugcuggggaaaaagcccugaagcucuccugguucaagaaaggcucaaguaucggaaagauguuugaggcaacugccagaggcgcuaggcggauggccauccugggggauaccgcaugggacuucggaagcauugguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguugcugggauccuggcccagggcaagaagaugauucgcccucaacccauggaguacaaauauucguggaaaagcuggggcaaggcgaagaucauaggggccgacgugcagaauacuaccuuuaucauugauggaccaaacacaccugaaugucccgacgaucagagagcuuggaauaucugggaggucgaggacuacggcuucgguauuuuuacuaccaacaucuggcuuaaguugagggauuccuauacacaggugugcgaccaccgucucaugucagcagccauaaaagauaguaaggcuguucacgccgacaugggguacuggauugaaucugagaaaaaugauacguggaagcuggcacgggcgagcuucaucgaagugaagaccuguauuuggccaaaaucccauacucuauggucaaacggaguacuggagagcgaaaugaucauacccaagaucuauggcgguccuauuucucaacacaauuaccgaccaggcuacuucacacagaccgccgggccguggcaucucggaaaacuggagcuugacuuugauuugugcgagggcacuacagucgugguggacgaacacugcgggaacagaggacccucccugaggaccacgacugucaccggcaagaucauucacgagugguguugccgcaguuguacauuaccuccacuccgguucagaggugaagacgggugcugguauggaauggagaucaggcccguuaaagagaaggaagagaaucuggugaaguccaugguaucugcuggcuccggugaaguggauucauuuagucuuggccuguuguguauaagcauuaugaucgaggaagucaugcgcucgcgauggucccggaaaaugcucaugaucgggacccuggccguguucuuucuacugauuaugggacagcucacuuggaacgaccugauccgucuuugcauuaugguuggcgcaaaugcuucugauagaauggggaugggaacaaccuacuuggcccugauggcaacauucaagaugaggccuauguuugccgugggcuuacucuuccgccggcugacuagcagagagguccuucugcuaaccauaggucucucacugguggcuagugcggaguugccaaacucccuggaagaguuaggggacggacucgccaugggcaucaugauucugaaacuucugacggauuuucaaucucaucaguugugggcaacacuccugagccuaaccuucaucaagacuaccuuuucccugcacuaugcuuggaaaacaauggccaugguucuuucaauugugagccucuucccccuguguuugaguacuaccucucagaagacgacauggcugccggucuuacucggcucccuggggugcaagccucuuaccauguuucugaucgccgaaaauaaaauauggggaagaaagagcuggccauugaacgaggguaucauggcuguaggcauugugucgauccuccugucaucucuacugaaaaacgacguuccccuugcagggccucucauugccggaggcaugcugaucgcguguuacgugauaagugguuccagcgcugauuugucuuuagaaaaggccgcagaggucagcugggaggaagaggccgaacauuccggggcuucacacaauauucugguggagguacaggacgauggaacuaugaaaaucaaggacgaagaacgagaugacacacucaccauccugcuuaaagcaacucuguuggccgugaguggcgucuucccccuaagcauuccagcgacacuguucguuugguauuuuuggcaaaagaagaaacagcgcucuggcgugcucugggauaccccuucacccccagagguggaacgggcuguccuggacgacgggauauacagaaucaugcagaggggacuuuuaggucguagccaggugggcguugggguauuccaagagaacguguuucauacgauguggcacgucacucgcggagccgugcugauguaucagggcaagcggcucgaaccgaguugggcaagcguuaaaaaggauuugauuuccuacggugggggauggagacugcagggcucuuggaauaccggcgaggaggugcaggucaucgccguggaaccugggaaaaaccccaagaauguacaaacagcuccaggaaccuucaagacacccgagggugaagucggcgccauugcacucgacuuuaaaccugggacuucgggaagcccaaucgugaacagggagggcaagauaguuggucuguacgggaauggaguggucaccacgucaggcacauauguguccgcuaucgcccaggcgaaagccagucaggaaggcccccuuccugagauugaggaugaaguuuuccgaaagcggaaccugacuaucauggacuugcacccggggucuggaaaaacccgcagauaccuaccagcaauugugagggaggcuaucaagcggaagcugcgaacacucauauuagcccccaccagagucguggcuagcgaaauggcagaggcccugaaagguaugccuauucgcuaucaaacuaccgccguaaaguccgaacauacaggcaaagagaucguggaucuuaugugccacgcuacguuuacuaugaggcugcucucaccaguucguguccccaauuacaacaugaucauuauggacgaggcgcauuucaccgauccuucuagcaucgcagcccggggguauauaaguacaagagugggaaugggcgaagcugccgcaauuuuuaugaccgccacuccgcccgguuccguggaggcuuucccacagagcaaugcggucauccaggacgaagagagggauauuccugaacgcucuuggaacucaggguacgaguggaucacagacuuucccggaaagaccguaugguucgugccauccauaaaaaguggcaaugauauugccaacuguuugcgaaagaauggcaagagaguuauccagcugagccggaaaacguucgacacugaguaucaaaagaccaaaaauaacgacugggauuacguggucaccaccgacaucucggaaaugggggcaaauuuuagggcugaucgcgugauugacccucguagaugccucaagcccguuauccugaaagauggaccagagcgggugauucuugccgguccgaugccugucacuguggcaucugccgcucagaggcgcggccgaauagggagaaaccacaauaaggaaggagaccaguacaucuauaugggccagccccuaaacaaugaugaggaccaugcccacuggacagaggcgaagaugcuguuggauaacauuaauaccccagaagguaucauccccgcauuauucgagccugaacgggagaaauccgccgcuauugacggggaauacaggcugcgcggcgaggccagaaagacauuuguagagcucaugaggcggggagaucugccaguguggcuuagcuauaaaguugcuucagaaggcuuccaauacagugaccgucgcuggugcuuugauggggagcgaaacaaucagguccuggaagagaacauggacguggaaauauggacuaaggagggagagaggaaaaagcucaggccccggugguuggacgcacgcacguauucugauccucuggcccuaagagaguucaaagaguuugcugccgguaggcgguccgugagcggcgaccugauccucgaaauugggaaacuuccgcagcaccugacccagcgagcacaaaaugcguuagauaacuuggucaugcugcauaauucagagcagggaggcagagccuaccgccacgcuauggaggaacucccagacacaaucgagacucugaugcuucuggcccucauugcaguuuugaccgguggggugacacuguucuuuuuaaguggcaggggacuaggcaagaccagcaucgggcugcucuguguaauggcuuccucugugcuucuguggauggccagcgucgaaccccauuggauagcagccuccaucauuuuggaguucuuucugauggugcuccugaucccugaacccgaucggcagcguacuccacaggacaaccaacuugcuuauguugugauuggacuccuguucaugaucuugacggucgcggccaaugagaugggucuguuagagaccaccaaaaaggaucuaggcauagggcacguagcaguggaaaaccaccaucacgcugccaugcuggacguugaucuccauccugccucagcauggacucuuuacgcuguggccaccacaauuaucacccccaugaugagacacacuauugagaacacaacggcgaauaucucucugaccgcuauagccaaccaggcagccaucuugaugggacuggacaaaggcuggccaauuaguaagauggauaucggugucccucuccuggcucuugggugcuacagccaggugaauccguuaacucugacagcagccguccucauguugguggcgcauuaugcuauuaucggccccggacugcaagccaaagcaaccagggaagcccagaagcgcaccgcugccggcauaaugaagaacccaacaguugacgggauuguggcaaucgaucuagacccuguaguguacgacgcuaaauuugagaagcagcugggacagaucaugcuccuuauucuguguacuagccaaaucuugcugaugcggacgaccugggcccucugcgaauccauaacacuggcgacuggccccuuaaccacacuuugggaggguucuccagggaaauucuggaauaccacuauugccgucucaauggcaaacaucuuccgaggaagcuaucuggcuggcgccggucucgcauuuucccuaaugaagagucugggcgggggaagaaggggcacgggggcucagggagagacauugggcgaaaaauggaagcgccggcugaaucagcucucuaagagcgaguucaacaccuacaaaagaucagguauuauggaaguugaucguuccgaggccaaggaagggcuuaaaaggggagagacuaccaagcacgccgugagucggggcacagcgaaacugcgcugguuugucgagcgaaauuuggugaagccugaagguaagguaaucgaccugggcugugggagaggaggcuggagcuauuacugcgcugggcucaaaaaggugacugagguuaaaggauauaccaagggcggucccgggcacgaggaaccgauaccaauggcaacauacggauggaacuuagugaaacugcauucuggcaaggaugucuucuuuaucccucccgaaaaaugugacacgcuucugugcgauauuggcgaguccucaccaaaucccaccaucgaggaagggaggacucuacgggugcucaagauggucgagccuuggcugcgcggaaaccaguucuguauuaagaucuugaauccguacaugcccagcgugguugaaacacuggagcaaaugcagagaaaacacgguggcaugcucguaaggaacccacuuucgcgaaauucuacccaugagauguauugggugaguugcgggacuggaaacauugucuccgccgugaauaugacaagccggaugcuguuaaaccguuuuaccauggcucacagaaagccuacguacgaacgcgacguugaucugggcgccgguaccaggcacguggcagucgagcccgaaguggccaacuuggacaucauagggcagcggauugagaauaucaaacaugaacacaagucaacauggcauuaugaugaggacaacccuuacaaaacuugggcuuaucacggauccuacgagguaaagccaucuggcagcgcgaguuccauggugaauggcguugucaagcuccugaccaaacccugggaugugaucccuauggugacacagauugccaugacugacaccacaccauucgggcaacagagagucuuuaaggaaaaaguugacacccgcacucccaaggcaaaaaggggaacggcucagauaauggaggugacagcccgauggcuaugggguuuccuuagccggaacaagaagccgagaaucuguaccagggaagaguuuacucgcaaaguacguucuaaugcagccauuggcgcuguguucaucgaugaaaaccaauggaacucagccaaggaggcggucgaggacgaacgguuuugggaucuggugcauagagagagggaacuccacaaacaggggaagugcgcaaccugcguuuauaacaugaugggaaaacgcgagaagaagcugggcgaguucgguaaagccaaggggagucgagcuauuugguacaugugguugggagcccgguuccuggaguuugaggcacucggcuucaugaaugaagaccacugguuuuccagagagaacagccuuucuggcguggaaggggagggacugcauaaauuagguuacauccugagggauauaucgaagaucccuggcgggaauauguaugcugacgauacagccggaugggacacgcgcauuaccgaggaugacuugcagaacgaagcuaaaaucacugauauuauggagccagaacacgcccuccuggcaaaggcgaucuucaaacuaacauaccagaauaaggucgugagaguacaacggcccgccaagaacggcaccguuauggacgugauaucaaggcgugaucagcgagguagcgggcaggucggaacuuauggccuuaauacauuuaccaacauggaggcucagcugauucgccaaauggaauccgagggcaucuucaguccuucugagcucgaaacaccaaaccuggccgagagaguguuggacugguuagggaaauacggaguggaacggcugaagaggauggcaaucagcggugacgauugugucguuaaacccauugacgaucgcuuugcuacugcccucaccgcacuuaaugacaugggcaaggugagaaaagauauaccgcagugggagccuuccaagggguggaacgacuggcagcagguacccuucugcucacaucacuuucaccaacugaucaugaaggauggacgggaaauuguggucccauguaggaaucaggacgagcuagugggccgagcccguguuagucagggugcgggguggucucugagagagacggcuugccucggaaaaagcuaugcccagauguggcaauugauguacuuccaucgccgggaucugaggcuugcagccaacgcuaucuguuccgccgugccugucgacugggugcccaccucaagaacaacuuggagcauucacgcacaucaccaguggaugaccacagaagauaugcugucuguauggaaucgcguuuggaucgaggaaaacccauggauggaggacaagacucauauauccaauugggaagacgugcccuaucucggcaaacgggaggaucaguggugcggcaguuuaaucgggcugaccgcuagggccacgugggcgacaaacauucaagucgcuaucaaucaggugcgaagauugauuggaaacgagaauuaccuggacuacaugaccagcaugaagcgguuuaaaaacgaaucggauccugagggugcccucugguga

SEQ ID NO: 13213 - RNA, 9879 nt, Artificial Sequence
  derived and/or modified CDS sequence (opt3) from DENV-1__JN903578__SS-prME
agcgugacaaugcugcucaugcuucugcccacagccuuggcuuuccacuuaacuacgagaggcggggagccucauaugaucgucuccaagcaagaaaggggaaaaucucuguuauuuaagacaucaguuggugugaacaugugcacacucauugccauggaccugggcgagcuuugugaagauacuaugaccuacaaaugcccacggauaacagaggccgaaccggacgauguagacuguuggugcaaugcgaccgauacuugggugacauaugggaccuguagccaaacgggagagcaccgccgagacaagcguagcgucgcucuggcaccccaugugggcuugggucucgagacuagaaccgaaacauggauguccucugagggggcauggaaacagauccagaggguugaaacuugggcccugcggcacccuggauucaccgugauugcucuguuucucgcacaugccaucggcacaucgauuacccagaagggcaucauauucaucuuacugaugcuugucacgccaucaauggcuaugcgcugcguggggauuggaaacagagauuuuguagaggguuugagcggcgccacuuggguugacgugguccuggagcacgggaguugugugacaaccauggcgaagaauaaacccacucuagauaucgaacuccugaagacagaggugaccaacccugcaguccuuaggaaacugugcauugaagccaagaucuccaauacgaccacagacucucgguguccaacucaaggagaggcuaccuugguugaagaacaggaugccaacuucgugugccgccgaacauuuguagacagaggcugggguaauggguguggacucuucggcaaaggcagccuguuaacuugcgcaaaguuuaagugcgugaccaaacuggaggggaaggucgugcaguacgaaaaccucaaauauuccguuauagugacaguccacaccggagaucagcaucaaguggguaaugagacuacggaacacggcacaauugcuaccaucacuccccaggccccuaccucagagauucagcuuacagacuacggggcgcugaccuuggacuguaguccaaggacuggacuagauuucaacgaaaugguacugcucacaaugaaggagaaaagcuggcugguucauaagcagugguuucuugaccugccguugcccuggacgucuggcgccuccaccucacaagagacuuggaaucggcaggaucuccuggugacauucaaaaccgcacacgcuaagaagcaggaagucguggucuuagguagccaagagggggccaugcacacagcucugacuggcgccaccgaaauccagacgaguggaaccacaacuaucuuugcaggccaucuaaaaugccgucucaagauggacaaacugacccuuaaggggaugucuuaugugauguguacaggauccuucaaauuggagaaggaaguugccgagacucagcacgguaccgugcugguacaggucaaguacgagggcacggaugcuccuugcaaaauuccauuccucauacaagacgaaaagggggugacacagaacggacgccugaucaccgcgaaucccauuguuacugauaaagagaagccugugaacaucgaaacagagccacccuuuggcgagagcuauauagucgugggugcaggggaaaaagcccuuaagcugucgagauucaagaaaggaucuuccauuggaaagauguuugaggcuaccgccaggggcgcacggcgaauggccaucuugggggacacugcuugggauuucggaucaaucgguggcguauuuaccaguguggggaaacucauucaucagguuuucggaacagccuacggcguccuguuuagcgguguguccuggacgaugaagaucgggauuggcauauuacugaccuggcuaggacucaauucucgcagcacuucacugaguaugacauguaucaccgugggcauggucacacuuuacuuggggguuauggugcaggcagacuccggaugcgugauuaacuggaaaggcagagaacugaagugugguagcgggaucuucguaacuaacgagguccacaccuggacggaacaauauaaguuucaggcggauucuccgaaaaggcucucagcugccaucggaaaggcaugggaggagggcgugugcgguauucggagugccacacgccuggaaaauauaauguggaaacagaucagcaacgaguuaaaucauauucugcuugaaaacgacaugaaguucaccguuguggucggcgacgcuaaugggaucuuggcccagggcaagaagaugauuagaccucaacccauggagcacaaauacuccuggaagucuuggggcaaggcaaaaaucauaggggcugauauccagaacacuaccuuuauuaucgacggaccagauacaccugaaugucccgacgaucagagggccuggaauauuugggagguggaggacuauggcuucgguaucuuuacuaccaacauauggcucaagcugcgugauucguacacacagaugugcgaccaccggcuaaugagcgcggccauuaaagauuccaaggcuguucaugcagacaugggguauuggaucgaaucagagaaaaaugaaacguggaagcuggcccgagcuaguuucauugagaucaagaccuguauauggccaaaaucucacacucucuggagcaacggagugcuggaauccgagaugaucauucccaagaucuacggcgguccuauuucacaacauaaucacagaccaggcuauuucacacagaccgccgggccguggcaccuuggaaaauuggagcuggauuuugacguaugcgaaggcacuacagucgugguggaugagcauugcgggaacaggggacccagcuuacgcaccacgacugucaccggcaagaucauacacgaaugguguugccggucuuguacacucccuccacugagauucaggggugaggacgggugcugguacggaauggagauucgccccguuaaagaaaaggaggaaaaucuugugcgauccaugguaagugcaggcagcggugagguggacucuuuuucccugggcuugcucugugucucaaucaugaucgaagaggugaugcggagucguuggagcagaaagaugcugaugaccgggacucuagcgguuuucuuucugcucauuaugggacagcugacauggaacgaucuuaucagguugugcauuauggugggcgccaaugucucggaccgcauggggaugggaaccacauaccuggcuuuaauggccacuuucaaaaugcggccuauguuugcagugggccuccuguucagaaggcuuaccucccgagagguucugcuacucacgauaggucugucuuugguggcuagcgccgaacugccaaacucauuagaggaacucggggauggacuggcaaugggcaucaugaugcuuaagcuguugacagacuuucaaagucaucagcucuggaccacucugcuaucccugaccuucauuaaaacaacucuuucucucgauuaugccuggaagaccaucacgaugauucugagcaucgucuccuuguuuccccuguguuuaucaacaaccagccagaaaacuacauggcucccgguacugcuuggcaguuucgggugcaagccucugaccauguuuuugauaacugagaacaagaucuggggacgcaaaucuuggccacucaaugaagguauuauggcugugggcaucguuuccauucugcuaagcucgcugcuuaagaacgacgugccccucgcggggccucugaucgccggaggcauguugauagcauguuacgucauuucagguucuagugcugauuuaucccuggagaaagccgccgaggugagcugggaagaggaagcugagcacucugggacaagccauaauauccucguagaagugcaggacgauggaaccaugaagaucaaagacgaggagcgggaugacacgcugacuauucuucugaaggcaaccuugcuagccgucuccggcguuuaucccaugucaauaccagcgacacuguucgugugguacuucuggcagaaaaagaagcagagaaguggcgugcucugggauaccccuagucccccagaagucgagagggcugugcuggacgacgggaucuaucguauucuucagcgcggauuacugggucggucucagguuggcguagggguguuucaagauggagucuuccacacaauguggcacgugacuagaggcgccguucucauguaccaggguaaaagguuggaaccguccugggcaucagugaagaaagaccugaucaguuaugggggaggcuggcgauuucagggcagcuggaacaccggggaggagguccaggugauugccguagaaccuggaaagaaucccaaaaacguccaaacgacaccagguacuuucaagacccccgagggcgaagugggggcuaucgcacucgauuuuaagccuggaacauccggcucuccaauaguuaaucgggaggguaaaaucguggggcuguacggaaacggcgucgugaccacuucgggcaccuacguuagcgccauugcgcaggcuaaggccucacaggaagggccccuuccugagaucgaggacgaaguguucaaaaagcgcaaucugacaauuauggauuugcauccgggauccgguaaaacgagaagguaucuaccagcaaucguccgggaggccauaaagcgaaagcugagaacucucauuuuagcucccacccgcgugguagccagugaaauggcagaggcucugaaaggcaugccuaucagguaccaaacaaccgccgugaagucugaacacacugggcgugagaucguugaccuuaugugccaugcgacauuuaccaugcggcugcucagcccagucagagugcccaacuauaauaugauuaucauggaugaggcccacuucacggacccugcauccauagcugccaggggauacauuucaacucgcgugggcaugggugaagcugcagccaucuuuaugacagccaccccgcccgggucugucgaggcuuucccacagagcaacgcgguaauucaggaugaagagaaagacaucccugaacgaaguuggaacuccggauaugauuggauaaccgacuuucccggcaagacugugugguucguuccaagcauuaaaucuggcaaugacaucgcaaauuguuugagaaagaacgggaagcgggugauccagcugucaaggaaaacauucgauaccgaguaccaaaagaccaaaaacaaugacugggauuaugucgugacuacggacauuuccgagaugggagccaacuuucgcgcugaucguguuaucgacccuagacggugccucaagcccgugauucugaaagaugguccagaaagggucauacuugccggcccgaugccugugaccguagcaagugccgcucagcgccgagggagaaucggacggaaucagaacaaggagggcgaccaguacguguacaugggucaaccccuaaauaacgauggggaccaugcgcacuggacagaagccaagaugcuguuggauaauauuaacacuccagagggcaucauccccgcauuauucgagccugaaagggagaaaagcgcugccauugacggagaauaucgccugagaggcgaggcaaggaagaccuuuguugaacucaugcggcguggggaucugccagucuggcuuucguacaaaguggccucugagggauuccaguauuccgaccgccgauggugcuuugacggugagagaaauaaccaggugcuggaagagaauauggaugucgaaauauggacaaaggagggcgaaaggaaaaagcuccggccccgcugguuggacgcuagaaccuacagcgauccucuggcccuaagggaguucaaagaguuugcggcagggcggcgaucaguuaguggagaccugauccucgaaauuggcaaacuuccgcagcaccugacuuuaagagcccaaaacgcuuuggauaaucuggugaugcuccauaacucugagcagggugggaaggccuaucgccacgcuauggaggaacugccagacacgaucgaaacccuuaugcugcucgcauugauugccguacugacaggcggagugacuuuauucuuucuauccggcaaagggcugggaaagaccagcaucggucuccuuugugucauggcuucaagugcccuguuguggauggcaagcguggagccccauuggauagcggccuccaucauucuggaguucuuucucaugguucugcuuaucccugaacccgauaggcagcggacaccacaggacaaucaacucgcuuacguggucauuggccuguuguucaugauccugaccguagccgcaaacgagaugggguuacuagaaacuaccaaaaaggaucugggaauaggccacguggcugccgagaaccaccaucacgcaacgaugcucgacguugaucuucguccugccucugcuuggacccuguaugcgguggccacuacagucauuacccccaugaugagacauaccaucgagaauacaacugcaaacauuagcuugacggcuaucgccaaucaggccgcaauacugaugggucucgacaaaggguggccaaucuccaagauggauauuggcgugccucugcuugcuuuaggaugcuacucacaggucaacccgcugacccucacagccgcgguguugaugcugguugcucacuacgccaucauuggccccgggcuacaagcaaaggccacuagggaagcucagaaacgcaccgcagccggaaucaugaagaauccaacaguggacggcauaguagcgauugaccuggauccuguggucuaugacgcuaaauuugagaagcagcucggucagaucaugcuucugaucuuguguaccucucaaauucugcucaugcggacuacgugggcccugugcgaaaguaucacauuagcaaccgggccccuuacuacccugugggagggaucgccaggcaaauucuggaacacaacuauagccguuagcauggcuaauauuuuccgagguuccuaccucgccggcgcagggcuagcuuuuucucugaugaagucauugggaggcagcagaagggggaccggagcccagggcgaaacacugggugagaaguggaaacgccagcucaaccagcuuuccaagagugaguucaauacguauaaacggucugggaucauggaaguggauagaagcgaggcgaaggaaggacugaaacguggcgagaccacuaagcaugccgucucaagggguacagcaaaguugcggugguuuguggaacgcaaccugguaaaaccugagggcaaggugauugaccucggguguggacgaggcgggugguccuacuauugcgcuggacugaaaaagguuaccgaggugaaaggcuacacuaagggugggcccggacacgaggaaccgaucccaauggccacauauggcuggaaucuagucaaacuucacaguggcaaggauguguucuuuauaccucccgaaaagugugacacccugcuaugcgauaucggggagagcucuccaaaccccacgauugaagagggaagaacccucaggguccugaaaaugguggagccuugguugcgggguaaucaauucuguaucaagauucugaacccguacaugcccuccguuguagaaacacucgagcagaugcagcgcaaacauggcgggaugcuugugagaaauccacugucaaggaacagcacucacgaaauguacugggucucgugcggaaccggcaauaucgugucugcaguuaacaugacaagucgaauguuacugaaccgguuuacuauggcucaucguaagccuaccuaugagagagacguggauuugggugccgggacacgccacgucgccguggagcccgaaguagcgaaucucgacauuaucggacagaggauagagaacauuaaaaaugaacacaaguccaccuggcauuacgaugaggacaacccuuauaagacuugggcuuaccacggcagcuaugaagugaaaccaucaggcuccgcaucuagcaugguuaauggggucgugcggcugcuaacgaagcccugggacgugaucccuauggucacacaaaucgccaugaccgauacuaccccauucggacagcagagaguuuuuaaagagaagguggacacacgcacgcccagggcuaaacgagguaccgcccaaauuauggagguaacugcaaaguggcuuuggggcuuccugagucggaacaagaaaccgagaauauguacaagggaagaguuuacccgcaaggugcguuccaaugccgcuaucggggcggucuucguggaugaaaaccaguggaauagcgccaaagaggcaguugaagacgagcgguuuugggaucucgugcauagagagagggaacugcacaagcagggaaaaugcgcuacuugcgucuacaacaugaugggcaagcgcgagaagaaauugggugaguucgggaaggccaaaggaucucgagcaauuugguauauguggcugggcgcccgguuccucgaguuugaagcucuuggcuucaugaaugaggaccauugguuuucaagagagaacagucuguccgggguggaaggagaggguuuacacaagcugggcuacaucuugagggauauuagcaaaaucccugggggaaauauguacgccgacgauacagcgggcugggacacccgcauaacagaagaugaccuccagaacgaggcaaagaucacugauauuauggagccagaacacgcccugcuagcuaccucuaucuucaaacuuacguaucaaaauaagguaguuagagugcagcggcccgccaagucggguaccgucauggacgugauuucaaggcgugaccagcgagggagcggacaggugggcacauacggccugaacacuuuuaccaacauggagguccaacucauccgccagauggaauccgaggggauauuccugccuagugaauuggagacaccaaauuuagcaaaaagaguucuggauuggcucgagaagcauggagcugaacggcuuaaaaggauggccauuucuggugacgauugugugguaaagcccaucgacgaucgcuuugcuacugcccugaccgcacuaaacgacaugggcaaagugagaaaggauaucccgcagugggagccuagcaagggguggaaugacuggcagcaaguccccuucugcucccaccauuuucaccagcugauuaugaaagauggacgggaaauagugguuccauguaggaaccaggacgagcucgugggccgagcgcgugucucacagggugccggguggaguuugagagaaacggcuugccugggaaagucuuaugcccaaauguggcagcuuauguacuuccaccgccgggaucugaggcucgcagcuaaugccaucuguagcgcagugccuguagacuggguucccacauccagaaccacuuggucaauucaugcccaccaucaguggaugacaaccgaggacauguuaagcguguggaaccgcgucuggaucgaggaaaauccauggauggaggauaaaacucacgugucuuccugggaagagguucccuaucugggcaagcgggaagaccaauggugcggcaguuugauugggcugaccgcgagggcuacaugggccacgaacauccagguggcaauaaaucagguccgaagacucaucggaaacgagaauuaccuugauuauaugaccacuaugaaacgguuuaagaacgagagcgacccugaaggugcccugugguga

SEQ ID NO: 13214 - RNA, 9879 nt, Artificial Sequence
  derived and/or modified CDS sequence (opt3) from DENV-1__JN903579__SS-prME
agcgugaccaugcugcucaugcuucugcccacagccuuggcuuuccacuuaacuacgagaggcggggagccucauaugaucgucggaaagcaggaaagggguaaaucccugcuauuuaagaccucugcaggcguuaacaugugcacacucauugccauggaccugggggagcuuugugaagauacuaugaccuacaaaugcccacggauaacagaggcggaaccggacgauguggacuguuggugcaaugcuaccgauacuuggguaacauauggaaccuguucacaaacgggcgagcaccgccgagacaagcguaguguggcccuggcaccccaugucgguuuggggcucgagacuagaaccgaaacauggaugagcuccgagggagccuggaggcagauccagaaaguggaaacuugggcucugcggcacccuggcuucaccguuauugcacuguuucucgcccaugcuaucggcacaucuauuacccagaaggggaucauauucaucuuacugaugcuugugacgccaucgauggccaugcgcugcgucggaauugguaacagagauuuuguggagggcuugucaggggcgacuuggguagacguugugcuggagcacggaagcugugucacaaccauggcaaagaauaaacccacucuagauaucgaacuccugaagacagaggugaccaacccugccgugcuuaggaaacugugcauugaagcuaagaucaguaauacgaccacagacucccgguguccaacucaaggcgaggccaccuuggucgaagagcaggaugcaaacuucguuugccgccgaacauuuguggacagagguugggggaauggauguggccucuucggcaaagggucucuguuaacuugcgcuaaguuuaagugcguaaccaaacuggagggaaagauagugcaguacgaaaaccucaaauauagcgucauugugacaguucacaccggugaucagcaucaagugggcaaugagacuacggaacacgggacaaucgccaccauuacuccccaggcgccuaccuccgagauccagcuuacagacuacggagcccugaccuuggacuguucaccaaggacuggccuagauuucaacgaaaugguccugcucacaaugaaggagaaaaguuggcuggugcauaagcagugguuucuugaccugccguugcccuggacgagcggugcaucuaccucccaagagacuuggaaucggcaggaucuccugguaacauucaaaaccgcucacgccaagaagcaggaaguuguggucuuagggucacaagagggcgcuaugcacacagcccugacuggagcaaccgaaauccagacgagcggcaccacaacuauuuuugccgggcaucuaaaaugccgucucaagauggacaaacugacccuuaagggagugaguuaugucauguguacagguucuuucaaauuggagaaggaaguggcugagacucagcacggcaccguucuggugcagguaaaguacgaggggacggaugcgccuugcaaaauaccauucuccacacaagacgaaaagggagucacccagaacggccgccucaucacugcaaaucccauugugacagauaaagagaagccuguuaacaucgaaaccgagccacccuuuggugagagcuauauagugauuggggccggcgaaaaagcucugaagcuuucgugguucaagaaaggaucuuccaucggcaagauguuugaggccacugcaagaggggccaggcggauggcuauccugggagacaccgccugggauuucgguucaauuggcggggucuuuacaagugugggaaaauugguacaucagguguucggcacggcauacgguguucucuuuagcggggucuccuggaccaugaagaucggcauuggaauacuguuaacuuggcugggccuaaauucucgaagcacaucacucaguaugaccuguaucgcgguggggauggugacacuguaccuuggagucaugguucaggcugacacuggcugcgugauuaacuggaaaggucgcgaauugaaguguggguccggaaucuucgugaccaacgagguacacacguggacagaacaauauaaguuucaggccgauagcccgaaaagacugucugcagccaucggcaaggcuugggaggagggugucugcggcauuaggucagccacccggcucgaaaauauaauguggaaacagaucaguaacgagcugaaucauauuuuacuggaaaacgacaugaaguucacugugguugugggggacgcaaauggaauccuuacccagggcaaaaagaugauucgcccucaacccauggagcacaaauacagcuggaaguccugggggaaggcuaaaaucauaggagccgauacacagaacacuaccuuuaucauugacggcccagauacaccugaaugucccgacgaucagagagcguggaauaucugggaggucgaggacuaugguuucgggauuuuuacgaccaacaucugguugaagcucagggauucuuacacucagaugugcgaccaccgucugaugucggccgcuauaaaagauagcaaggcagugcaugccgacaugggauauuggauugaauccgagaaaaaugaaacauggaagcuagcucgggccucauucaucgagguuaagaccuguauuuggccacgaagucacacucuguggucuaacggcgugcucgaaagcgagaugaucauacccaaaaucuacgguggcccuauuucccaacauaauuauagaccaggguacuucacacagaccgcaggaccguggcaccugggcaagcuugaguuggauuuuaaccugugcgaagggacgacuguagucguggacgagcacugcggaaauaggggccccucauuacgcaccacaaccgugacugguaaaaucauucaugaaugguguugccggagcuguacacucccuccacugagauucaggggggaggauggaugcugguacggcauggagauccgccccgucaaggaaaaagaggaaaaccuuguucgaucuaugguguccgcggguaguggcgagguagacagcuuuucucugggguugcucuguguguccauaaugauugaagaggucaugcggucacguuggaguagaaagaugcugaugaccggaacacuagccguguucuuucugcucaucaugggccagcugacuuggaaugaccuuaucagguugugcauuaugguuggggcuaacgugagcgaucgcaugggaaugggcaccacguaucuggccuuaauggcaacauucaagaugcggccuauguuugcugucggucuccuguucagaaggcuuaccucgcgagaggugcugcuacucacuaucgggcuguccuugguugccucugcagaacugccaaacagcuuagaggaacucggagacggccuggccaugggcauuaugaugcuuaaacuguugaccgauuuucaaucacaccagcucuggacaacucugcuaagucugaccuucauaaagacgacacuuucccucgacuacgcuuggaaaaccaucgcgaugauucugucuaucgugagcuuguuuccccuguguuuauccacuacaucacagaagaccacuuggcucccgguccugcuugggagcuucggaugcaaaccucugacaauguuuuugauuaccgagaauaagaucuggggucgcaagaguuggccacucaacgaaggcauaauggccguagggaucgugucuauucugcuauccagccugcuuaaaaaugauguuccccucgcaggaccucugaucgcuggcgguauguugauugccuguuaugugaucucggggucaucugccgacuuaagucuggagcgggcugcagaggucuccugggaagaggaagccgagcauagcggagcgucucacaacauacucguggaaguacaggaugacggcacgaugaagauuaaagaugaggagagagacgauacucugaccauccuucugaaggcuacauugcuagccgugagcggcgucuaccccauguccaucccagcaacccuguucguuugguauuucuggcaaaaaaagaaacagaggucaggggugcucugggacacaccuagucccccagaaguggagcgugccguccuggaugacggaauuuaccgcauacuucagcgggguuuacugggcagaagccagguggggguuggaguauuucaagacggcguguuccauacuauguggcacgucaccaggggugcugugcucauguaucaggggaagcgauuggaaccgucuugggcauccguuaagaaagaucugaucucauacggaggcggcuggcgguuucaggggaguuggaauacgggagaggaggugcaggucauugccguggaaccugguaagaaccccaaaaauguacaaacaacuccaggcaccuucaagacacccgagggggaagucggagcgaucgcucucgacuuuaaaccuggcaccagcgguuccccaauugugaaccgcgaggggaagaucguuggacuguacggcaauggcguggucacuaccucugggacauaugugucggccauagcacaggccaaggcuagccaggaaggaccccuuccugagaucgaggaugaaguuuucaaaaagagaaaccugacgauuauggacuugcacccggguucaggcaaaacuaggcgguaccuaccagccaucgugcgagaggcaauuaagagaaaacugcgcacccucaucuuagcucccacaagggucguggccuccgaaauggcggaggcccugaaggggaugccuauacguuaucaaaccacugcaguaaagagugaacauacaggacgggagauuguggaucuuaugugccacgcuaccuuuacgaugagacugcucucuccaguuaggguccccaauuacaacaugaucaucauggacgaggcccauuucacugauccugcuagcauugcagcccgcggcuauaucuccacacgaguggguaugggggaagccgcugcgauauuuaugaccgcaaccccgcccggaucaguggaggccuucccacagucuaaugcugucauucaggacgaagagagagauaucccugaacggagcuggaacaguggcuacgacuggauuacugauuuucccggcaaaacaguaugguucgugccauccaucaagagcgggaaugacauagccaacuguuugaggaaaaacggaaagcgcguuauucagcugucucguaaaaccaucgacacagaguaucaaaagacuaagaauaacgauugggacuacguggucacgaccgauaucucagagaugggugcaaauuucagagccgaccgggugauugauccuaggcgcugccucaaacccguuauccugaaggacggcccagaacgagugauucuugcugggccgaugccugucacagcggccuccgcagcucagagacggggaaggauaggccgcaaccagaauaaagagggugaucaguacaucuauauggggcaaccccuaaacaaugacgaagaucacgcccauuggacugaggcaaagaugcuguuggacaacauuaauaccccagagggcaucauccccgccuuauuugaaccugagagagaaaaaagugcugccauugauggagaguacaggcugcggggcgaagcgcguaagacauucguggagcucaugcgccgaggggaccugccaguauggcuuagcuauaagguggcaucggagggauuucaguacucugauagaagguggugcuucgacggugaacggaacaaucagguucuggaggaaaacauggacgucgagauauggaccaaagaaggcgagcgcaagaaacucagacccaggugguuggaugcccggacuuauuccgacccucuggcucuacgagaguuuaaggaauucgccgcugggagacgcagcgugucaggagaucugauccucgagauuggcaaacuuccgcagcaccugacguuaagggcacaaaaugccuuggacaaccuggugaugcuccacaauagugaacagggugggaaggcuuaccggcaugccauggaggaacugccagauaccaucgagacacuuaugcugcucgcauugauugcgguccugacuggcggaguuaccuuauuuuuccuaucuggcaaagggcugggaaagacauccaucggucuccuuugugugauggccagcucaguacuguuguggauggcuaguguggagccccacuggauagccgcaagcaucauucuggaauuuuuccucaugguccugcuuaucccugagcccgaccgucagagaaccccacaggauaaccaacucgcuuaugugguuauuggcucccuguuuaugaucuugacuguggccgcaaacgaaauggggcuguuagagacaacgaagaaagaccuaggaauaggccaugucguagccgagaaucaccaccaugcuaccacucuggauauugaccuccacccugcgucugccuggacacuuuacgcaguggcuaccaccaucauuacacccaugaugaggcauacuaucgaaaacacgaccgccaauauaagccugacagccaucgcaaaccaggcugccauuuugaugggucuggauaagggguggccaaucuccaaaauggacauuggcguuccucuccuggcgcuuggaugcuacucacaggugaauccguuaacucugaccgcugccguccucauguugguggcacacuaugccaucauaggccccgggcugcaagcuaaggcaacacgcgaggcccagaaacggaccgcggcuggaauuaugaagaacccaacugucgauggcaucguggccaucgaccuagacccuguuguguacgaugcaaaguucgaaaaacagcugggucagauuaugcuccuuauccuguguacgucucaaauauugcugaugcgaacaaccugggcccucugcgagaguauuacucuggcuaccgggcccuuaacaacucuuugggaaggaucgccaggcaaguuuuggaauaccacaaucgccguaagcauggcaaacauuuucagagguuccuaucuggcuggcgccgggcucgcguucucucuaaugaaaucacugggaggcgggaggcgcggaacgggcgcccagggugagaccuugggggagaaguggaaacggcagcugaaucagcucagcaaguccgaauuuaacacuuacaagagaaguggaaucauggagguggaccguucugaagcaaaagagggccuuaagaggggugaaacaaccaaacaugcugucagccggggcacugccaagcugcgcugguucguugagcgaaauuuggugaaaccugaggggaaggucauagaucugggauguggcagagggggauggucauauuacugcgcaggccucaagaaagugacagaaguaaaggguuauaccaaagggggacccggccacgaggaaccgaucccaauggcuacguacggcuggaacauugugaaguuacacuccgggaaagacguuuuuuucaccccucccgagaagugugauacacugcuuugcgacaucggagaaaguagcccaaaucccacuauugaggaggguaggacccugcgggugcuaaaaauggucgaaccuuggcuccgcggcaaccaauuuuguaucaagauucugaauccguacaugcccucuguggucgagacauuggaacagaugcagagaaagcaugggggaaugcuggugaggaacccacucucccgaaauucaacucacgagauguauuggguuagcugcggcaccgguaacaucguaucggccgugaacaugacaucucggaugcuucugaaucguuucaccauggcccauagaaaaccuacuuacgagcgcgaugucgacuuaggggcgggaacgaggcacguggcuguugaacccgagauagcaaaccuggauauuaucggccagcggaucgaaaauauuaagaacgagcacaaaaguacauggcauuaugacgaagauaauccuuacaagaccugggccuaucacggcuccuacgaggugaaaccaagcgggucagcuuccucuauggucaacggagugguaagauugcucacuaagcccugggacgugauaccuaugguuacccaaaucgccaugacagacacgaccccauuuggucagcagcgcgucuucaaggagaaaguggauacuaggacaccccgaccgaagcggggcaccgcacaaauuauggaagugacugccaaauggcuguggggguuucuaagcagaaauaagaaaccuaggaucuguacacgcgaggaauucacccguaagguccggaguaacgcugcgauuggagccguuuuuguggacgagaaucaguggaacuccgcaaaggaagcuguagaggaugagagauucugggaccuugugcauagggaacgcgagcugcacaaacagggcaagugcgccacaugcgucuauaauaugauggguaaacgagaaaagaaacucggggaguuuggaaaggcaaagggcagccgggccaucugguacauguggcugggcgcuagauucuuggaauucgaggcccugggguuuaugaacgaggaucauugguucucuagggaaaauucacucaguggaguggagggugaaggccuuuacaaacugggguauauauuacgcgacaucuccaagauuccaggaggcaacauguacgcggaugacacugcagguugggauaccagaaucacggaggacgaucugcagaaugaggccaaaauuaccgacaucauggaacccgagcacgcuuugcucgccacaagcauauuuaagcugacuuaucaaaacaaaguugugcggguccagaggccugcaaagucugggaccgugauggauguaauuucgcgucgagaccagcgcggaucaggccagguuggcacauacgggcuaaacacuuucaccaauauggaagugcaacuuaucagacagauggagagcgaaggaaucuuuuccccaagugagcuggagaacucuaaucucgcugaacggguccuggacugguuggagaaacacgguguggaaagguuaaagcgcauggccauuagcggcgaugacuguguggucaagcccacggaugacagauucgcuacagcccugaccgcacucaacgauauggggaaaguucggaaggacauaccgcagugggagccuuccaaaggauggaaugauuggcagcaagugcccuuuugcucacaucacuuccaucagcuuaucaugaaggacggcagggaaauuguagugccaugucgaaaccaggaugagcuggucggucgugcgagagugagucagggggccggauggucucuacgcgagacugcuugccugggcaaaagcuaugcccaaauguggcagcucauguacuuucaccggagggacuugagacuggcagcuaaugccaucuguuccgcaguuccugugaacuggguccccacaucacgcaccacuuggagcauucacgcccaucaccaguggaugaccacagaagauaugcuuucuguguggaaucggguauggaucgaggaaaacccauggauggaggacaagacgcauguuuccaguugggaagacgugcccuaucugggcaagagggaggaucaauggugcgggagccucauaggauuaaccgcgcgagcuacuugggccacaaauauccaggucgcaauuaaccaggugagacggcugaucgguaaugagaacuacucggacuacaccacuuccaugaaaagguucaagaaugaaucugauccugagggcgccuugugguga

SEQ ID NO: 13215 - RNA, 9879 nt, Artificial Sequence
  derived and/or modified CDS sequence (opt3) from DENV-1__JN903580__SS-prME
agcgugaccaugcugcucaugcuucugcccacagcauuggcuuuccacuuaacuacgagaggaggggaaccucauaugaucgucuccaagcaggaaaggggaaaaucucuguuauuuaagaccucagccgguguuaacaugugcacacucauugccauggaccugggagagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccauucagcacacaagacgaaaagggggucacccagaacggacgccucaucacugcaaaucccauugugacagauaaagagaagccuguuaacaucgaaaccgagccacccuuuggcgagucguauauagugauuggugccggggaaaaagcucugaaacuuucuugguucaagaaaggcuccucaaucggaaagauguuugaggccacugcaagaggcgccaggcggauggcuauccugggggacaccgccugggauuucggaaguauugguggcgucuuuacaagcguggggaaauugguacaucagguguucggaacggcauacggcguucucuuuuccggugucucuuggaccaugaagaucgggauuggcauacuguuaacuuggcugggacuaaauagccgaaacacaucacucaguaugaccuguaucgcggugggcauggugacacuguaccuuggggucaugguucaggcugacacuggaugcgugauuaacuggaaaggccgcgaauugaagugugguuccgggaucuucgugaccaaugagguacacacguggacagaacaauauaaguuucaggccgauagcccgaaaagacugucugcagccaucggaaaggcuugggaggagggcgucugcgguauuaggucagccacccggcucgaaaacauaauguggaaacagaucaguaaugagcugaaccauauuuuacuggaaaaugacaugaaguucacugugguugugggcgacgcaaacgggauccuuacccagggcaagaagaugauucgcccucaacccauggagcacaaauacagcuggaaguccuggggcaaggcuaaaaucauaggggccgauacacagaauacuaccuuuaucauugacggaccagauacaccugaaugucccgacgaucagagagcguggaacaucugggaggucgaggacuauggcuucgguauuuuuacgaccaauaucugguugaagcucagggauucuuacacucagaugugcgaccaccgucugaugucggccgcuauaaaagauagcaaggcagugcaugccgacaugggguauuggauugaauccgagaaaaacgaaacauggaagcuagcucgggccucauucaucgagguuaagaccuguauuuggccacgaagucacacucuguggucuaauggagugcucgaaagcgagaugaucauacccaaaaucuacggcgguccuauuucccaacauaacuauagaccaggcuacuucacacagaccgcagggccguggcaccugggaaaacuugaguuggauuuuaaucugugcgaaggcacgacuguagucguggacgagcacugcgggaacaggggacccucauuacgcaccacaaccgugacuggcaaaaucauucaugaaugguguugccggagcuguacacucccuccacugagauucaggggugaggaugggugcugguacggaauggagauccgccccgucaaggaaaaagaggaaaaucuuguucgaucuaugguguccgcgggcaguggugagguagacagcuuuucucugggcuugcucuguguguccauaaugauugaagaggucaugaagucacgguggagucguaagaugcugaugaccgggacacuagccguguucuuucugcucaucaugggacagcugacuuggaacgaccuuaucagauugugcauuaugguuggcgcuaacgugagcgauaggauggggaugggaaccacguaucuggccuuaauggcaacauucaaaaugcgcccuauguuugcugucggccuccuguuccggagacuuaccucgagggaggugcugcuacucacuaucggucuguccuugguugccucugcagaacugccaaauagcuuagaggaacucggggacggacuggccaugggcauuaugaugcuuaagcuguugaccgauuuucaaucacaccagcucuggacaacucugcuaagucugaccuucauaaaaacgacacuuucccucgacuacgcuuggaagaccaucgcgaugauucugucuaucgugagcuuguuuccccuguguuuauccacuacaucacagaaaaccacuuggcucccgguccugcuuggcagcuucgggugcaagccucugacaauguuuuugauuaccgagaacaagaucuggggacgaaaaaguuggccacucaaugaagguauaauggccguaggcaucgugucuauucugcuauccagccugcuuaagaacgauguuccccucgcagggccucugaucgcuggaggcauguugauugccuguuaugugaucucggguucaucugccgacuuaagucuggagcgcgcugcagaggucuccugggaagaggaagccgagcauagcggggcgucucacaauauacucguggaaguacaggaugacggaacgaugaaaauuaaggaugaggagcgggacgauacucugaccauccuucugaaagcuacauugcuagccaucagcggcguguaccccauguccauuccagcaacccuguucgucugguauuucuggcaaaagaaaaagcagagaucaggcguucucugggacacaccuagucccccagaaguggagagggccgugcuggaugacgggauauaccguauccuucagcgcggauuacugggucggagccaggucggcguggggguuuuucaagacggaguauucagaacuauguggcaugugaccaggggcgcuguccucauguaucaggguaagcgauuggaaccgucuugggcauccgugaaaaaggaucugauuucauacgggggaggcuggcgguuucagggcaguuggaacacgggggaggagguucaggugaucgccgucgaaccuggcaagaaucccaagaacgugcaaacaacuccagguaccuucaaaacacccgagggcgaaguaggggcgauugcucucgacuuuaagccuggaaccagcggcuccccaaucgucaaucgcgaggguaagauaguggggcuguacggaaacggcguugugacuaccucuggcacauaugucucggccaucgcacaggccaaagcuagccaggaagggccccuuccugagauugaggaugaaguguucaagaaaagaaaucugacgaucauggacuugcacccgggaucagguaagacuaggcgguaccuaccagccauuguucgagaggcaaucaaaagaaagcugcgcacccucauauuagcucccacaaggguggucgccuccgaaauggcggaggcccugaagggcaugccuauucguuaucaaaccacugcagugaaaagugaacacacagggcgggagaucguagaucuuaugugccaugcuaccuuuacgaugagacugcucucuccagugaggguucccaacuacaauaugaucauuauggacgaggcccacuucacugauccugcuagcaucgcagcccgcggauauauauccacacgagucggcaugggugaagccgcugcgauuuuuaugaccgcaaccccgcccgggucaguggaggccuucccacagucuaacgcugugauccaggacgaagagagagauauuccugaacggagcuggaauaguggauacgacuggaucacugauuuucccggcaagacagucugguucguaccauccauaaaaagcggcaacgacauugccaacuguuugaggaagaaugggaaacgcgugauccagcugucucguaagaccuucgacacagaguaucaaaagacuaaaaacaaugauugggacuacguugugacgaccgauaucucagagaugggagcaaacuuuagagccgaccgggucauugauccuaggcgcugccucaagcccgugauccugaaagacgguccagaacgaguuauucuugcuggcccgaugccugugacagcggccuccgcagcucagagacgggggaggauaggacgcaaucagaacaaggagggcgaucaguacaucuauaugggucaaccccuaaauaacgacgaagaucaugcccacuggacugaggcaaaaaugcuguuggacaauauuaacaccccagaggggaucauccccgccuuauucgaaccugagagagaaaagagugcugccauugauggcgaguacaggcugcggggagaagcgcguaagacauuugucgagcucaugcgccgaggcgaccugccaguguggcuuagcuauaaaguagcaucggagggguuccaguacucugauagaagguggugcuuugacggagaacggaauaaccaggugcuggaggaaaauauggacguugagauauggaccaaggaaggugagcgcaaaaagcucagacccaggugguuggaugcccggacuuauuccgacccucuggcucuacgagaguucaaagaauuugccgcuggcagacgcagcgucucaggggaucugauccucgagauuggaaaacuuccgcagcaucugacguuaagggcacaaaacgccuuggacaaucuggugaugcuccacaacagugaacagggcgguaaggcuuaccggcacgccauggaggaacugccagauaccaucgagacacuuaugcugcucgcauugauugcggugcugacugggggcgucaccuuauucuuucuaucuggaaagggccuggggaagacauccaucggacuccuuuguguuauggccagcucagugcuguuguggauggcuaguguagagccccauuggauagccgcaagcaucauucuggaguucuuucucauggugcugcuuaucccugagcccgaccgucagagaaccccacaggauaaccaacucgcuuaugucgugauuggucuguuguucaugauccugacuguugccgcaaaugaaaugggcuuacuagagacaacgaaaaaggaccuggggauaggacacguggucgccgagaaccaucaccacgcuaccaugcucgauauugaccuucauccugcguccgccuggacucuguacgcaguagcuacaaccaucauuacccccaugaugaggcacacaaucgaaaauacuacggccaacauaucuuugaccgccaucgcaaaucaggcugccauucugaugggccucgauaaagguuggccaaucagcaagauggacauuggggugccucugcuugcguuaggcugcuacucccagguuaacccgcugacacucacugcugccguguugaugcuggucgcacauuaugccaucauaggacccggccuacaagcuaaagcaacccgcgaggcccagaagcggacagcggcugggauuaugaagaauccaaccguggauggaaucgucgccaucgaccuggacccugugguuuacgaugcaaaauuugaaaagcagcucggccagauuaugcuucugaucuuguguacuucacaaauacugcucaugcgaacgacaugggcccugugcgagucuauuaccuuagcuacugguccccuuaccacacugugggaagggaguccaggaaaauucuggaacacuaccaucgccgugucgauggcaaauauuuucagaggcagcuaucucgcuggugccggccuagcguuuucccugaugaagucucuagggggaggcaggcgcgacacaggggcccagggagagacgcugggcgagaaauggaagcggcagcucaaccagcuuucaaagccugaguucaauaccuacaaaagaagcgguaucauggagguagaucguuccgaagcaaaggaggggcugaaaaggggagaaacuacaaagcacgcugugagucggggcaccgccaaauugcgcugguuugucgagcgaaaccugguuaagcccgaggguaaggugauagaccucggcugugggagaggaggcuggucuuauuacugcgcagggcugaaaaaggucacugaagugaaaggauauacaaagggcgguccggggcaugaggaaccaaucccuauggcuaccuacggauggaauauuguaaaacuacacagcggcaaggauguguucuuuacgcccccagagaaaugugacacccuucugugcgauaucggcgaaucaucccccaacccuacaauugaggaggggaggacucuacggguucucaagaugguggaaccguggcugcgcggaaaucaauucuguaucaagauuuugaaccccuacaugccaagugucguggagacccuggaacagaugcagagaaaacacgguggcaugcucgucaggaauccucuuagccgaaacucuacacaugagauguauuggguguccugcgggacuggaaacaucguuucagccguaaauaugaccagccggaugcuguuaaaccguuuuacaauggcccacagaaagcccaccuacgagcgcgacguggaucugggcgcggguacuaggcaugucgcuguggaaccugagauagcaaauuuggacauuaucgggcagcggauggaaaacaucaaaaaugagcacaagucgacguggcacuaugaugaagacaacccauacaaaacaugggccuaucauggaucuuacgagguuaagcccaguggcuccgcuagcucaauggugaauggcgucgugagacuccugaccaagccuugggacguaauuccaauggugacucaaauagccaugaccgauacaacgcccuucgggcagcagcgcguuuuuaaagagaaggucgacaccaggacuccgcgaccuaaacggggaacagcacaaaucauggaagugaccgccaaguggcuaugggguuuccuuuccagaaacaaaaagccaaggauuuguacucgcgaggaauuuacacguaaggugcggucuaaugcugcgaucggcgccgucuucguugaugagaaccaguggaauagcgcaaaagaagcuguggaggacgagagauuuugggaucugguacacagggaacgcgagcuccauaagcaggggaaaugcgcaaccugcguguauaacaugaugggaaagcgagagaaaaagcugggcgaguucgguaaggccaaagggagucgggccauuugguacaugugguugggagcuagauuccuggaauuugaggcccucggcuucaugaaugaggaccacugguuuuccagggaaaacagccuuucuggcgucgagggggaaggacuguacaaguuagguuauauccugcgcgauauaucaaaaauccccggcgggaauauguacgcggacgauacagcaggaugggacacuagaauuaccgaggaugacuugcagaacgaggccaagaucacggauauuauggaaccugagcaugcucuccuggccaccaguaucuucaaacuaacauaucaaaacaaggugguucgggugcagaggccagcaaaauccggcacugucauggacgugauaagccgucgagaccagcgcgguucugggcagguaggaaccuacggccuuaauacauuuacuaacauggaaguucaacugauuagacagauggagucggaaggcaucuucucacccagcgagcucgaaaauuccaaccuggcugaacggguguuggauugguuagagaagcacggggucgaaaggcugaagcgcauggccaucaguggagacgauuguguggugaaaccgaccgacgauagauuugcuacggcccucacagcacuuaaugacauggguaagguccggaaagauauuccucagugggagcccucuaagggcuggaacgacuggcagcaaguuccauucugcagccaccauuuucaccagcugauaaugaaagaugggagggaaaucgugguaccuugucgaaaucaggacgagcuagugggacgugcgagagucucccagggcgccgguuggucacugcgcgagaccgcuugccucgggaagaguuaugcccaaauguggcaguugauguacuuccaucggagggaucugagacuugcagcuaacgccauuuguucugcagugcccguuaauugggugccaacuagccgcacaaccugguccauccacgcccaccaucaguggaugacuaccgaagacaugcugucagucuggaaccggguguggauugaggaaaaucccuggauggaggacaagacacacguaagcucuugggaagauguuccuuaucucggaaaaagggaggaccaauggugcggcuccuuaaucggccugacggcgcgagcuaccugggccacuaacauacagguggcaaucaaucaggucagacgguugauugggaacgagaauuacagugauuacaugacaagcaugaagagguuuaaaaacgaaucggacccagagggagcccugugguga

SEQ ID NO: 13216 - RNA, 9879 nt, Artificial Sequence
  derived and/or modified CDS sequence (opt3) from DENV-1__JN903581__SS-prME
agcgugaccaugcugcucaugcuucugcccaccgcauuggcuuuccacuuaacuacgagaggaggggaaccucauaugaucgucuccaagcaagaaaggggaaaaucucuguuguuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccauucagcacacaagacgaaaagggggucacccagaacggacgccucaucacugcaaaucccauugugacagauaaagagaagccuguuaacaucgaaaccgagccacccuuuggcgagucguauauagugauuggugccggggaaaaagcucugaaacuuucuugguucaagaaaggcuccucaaucggaaagauguuugaggccacugcaagaggcgccaggcggauggcuauccugggggacaccgccugggauuucggaaguauugguggcgucuuuacaagcguggggaaauugguacaucagguguucggaacggcauacggcguucucuuuuccggugucucuuggaccaugaagaucgggauuggcauacuguuaacuuggcugggacuaaauagccgaaacacaucacucaguaugaccuguaucgcggugggcauggugacacuguaccuuggggucaugguucaggcugacacuggaugcgugauuaacuggaaaggccgcgaauugaagugugguuccgggaucuucgugaccaaugagguacacacguggacagaacaauauaaguuucaggccgauagcccgaaaagacugucugcagccaucggaaaggcuugggaggagggcgucugcgguauuaggucagccacccggcucgaaaacauaauguggaaacagaucaguaaugagcugaaccauauuuuacuggaaaaugacaugaaguucacugugguugugggcgacgcaaacgggauccuuacccagggcaagaagaugauucgcccucaacccauggagcacaaauacagcuggaaguccuggggcaaggcuaaaaucauaggggccgauacacagaauacuaccuuuaucauugacggaccagauacaccugaaugucccgacgaucagagagcguggaacaucugggaggucgaggacuauggcuucgguauuuuuacgaccaauaucugguugaagcucagggauucuuacacucagaugugcgaccaccgucugaugucggccgugauaaaagauagcaaggcuguucaugcagacaugggguauuggauugaauccgagaaaaacgaaacauggaagcuagcccgggcuucauucaucgaggugaagaccuguauuuggccacgaagucacacucuguggucuaauggaguacucgaaagcgagaugaucauacccaaaaucuacggcgguccuauuucccaacauaacuauagaccaggcuacuucacacagaccgccgggccguggcaccugggaaaacuugaguuggauuuuaaucugugcgaaggcacgacugucgugguggacgagcacugcgggaacaggggacccucauuacgcaccacaaccgucacuggcaaaaucauucaugaaugguguugccggagcuguacacucccuccacugagauucaggggugaggaugggugcugguacggaauggagauccgccccguuaaggaagaggaagagaaucuugugcgaucuaugguauccgcaggcaguggugaaguggacagcuuuucucugggcuugcucugugucuccauaaugauugaggaggugaugaaaucacgguggagucguaagaugcugaugaccgggacacuagcgguuuucuuucugcucaucaugggacagcugacuuggaacgaccuuaucagauugugcauuauggugggcgccaacgucagcgauaggauggggaugggaaccacguaucuggcuuuaauggccacauucaagaugcgcccuauguuugcagugggccuccuguuccggagacuuaccucgagggaaguucugcuacucacuaucggucuguccuugguggcuucugccgagcugccaaauagcuuagaagaacucggggacggacuggcaaugggcauuaugaugcuuaaacuguuggccgauuuucaaucacaccagcucuggaccacacugcuaagucugacuuucauaaagaccacgcuuucccucgacuacgcuuggaaaacaaucgcgaugauucugucuaucgucagcuuguuuccccuguguuuauccaccacuucacagaagacaaccuggcucccgguacugcuuggcagcuucgggugcaaaccucugacuauguuuuugauuacagaaaacaagaucuggggacgaaagaguuggccacucaaugaggguauaauggccgugggcaucguuucuauucugcuauccagccugcuuaaaaacgaugugccccucgcagggccucugaucgcuggaggcauguugauugccuguuaugucaucucggguucaucugccgacuuaagucuggagcgcgcugcagaaguguccugggaggaagaggccgaacauagcggggcgucucacaauauacucguagaggugcaggaugacggaaccaugaagauuaaagaugaggaacgggacgauacgcugacuauccuucugaaggcuaccuugcuagccaucagcggcgucuaccccauguccauuccagcaacacuguucguuugguauuucuggcagaagaagaaacagagaucaggcgugcucugggacaccccuagucccccagagguggaaagggccguccuggaugacgggauauaccguauccuucagcgcggauuacugggucggagccaggugggcguugggguauuucaagacggaguguuccauacaauguggcacgucacuagaggcgcugugcucauguaucaggguaagagguuggagccgucuugggcauccguuaagaaagaucugauuucauacgggggaggcuggcgauuucagggcaguuggaacaccggggaggaagugcaggucaucgccguggagccuggaaagaaucccaaaaacguacaaacgacaccagguacuuucaagacccccgaaggcgaggucggggcgauugcucucgacuuuaaaccuggaacaagcggcuccccaaucgugaaucgggaagguaagauaguugggcuguacggagauggcguggucaccacuucuggcaccuaugugucggccaucgcacaggccaaggcuagccaggaggggccccuuccugagauugaagacgagguuuucaaaaagcgcaaccugacaaucauggauuugcacccgggaucagguaaaacgagaagguaccuaccagccauugugcgggaagcaaucaagcgaaaacugagaacucucauauuagcucccacccgcgucguggccuccgagauggcggaagcccugaagggcaugccuauuagguaucaaacaaccgcaguaaagagugagcauacugggcgugagaucguggaccuuaugugccacgcuacauuuaccaugcggcugcucucuccaguuagaguccccaauuacaacaugaucauuauggaugaagcccauuucacggacccugcuagcaucgcagccaggggauauauauccacucgcgugggcaugggugaggccgcugcgauuuuuaugacagcaaccccgcccgggucaguggaagccuucccacagucuaaugcugucauccaggaugaggaacgagacauuccugagagaagcuggaacaguggauacgauuggaucaccgacuuucccggcaaaacuguaugguucgugccauccauaaagagcggcaaugacauugccaacuguuugcggaaaaacgggaagaggguuauccagcugucucgcaaaacauucgauaccgaguaucaaaagacaaagaauaacgacugggauuacguggucacuacggacaucucagaaaugggagcaaauuuucgugccgauagagugauugacccucggaggugccucgagcccguuauccugaaagaugguccagaacgcgugauucuugcuggcccgaugccugucaccgcggccuccgcagcucagcgaagagggcggauaggaaggaaccagaauaaggagggcgaccaguacaucuauaugggucaaccccuaaacaaugaugaggaccacgcccauuggacagaagcaaaaaugcuguuggauaacauuaauacuccagaggggaucauccccgccuuauucgaaccugagcgcgaaaagagugcugccauugacggcgaguacagacugaggggagaggcgcggaaaaccuuuguggaacucaugcgucgcggcgaucugccaguauggcuuagcuauaagguggcaucggagggguuccaguacucugaccgaagauggugcuuugacggagaaaggaacaaucagguucuggaggaaaacauggaugucgagauauggacaaaggagggugaacggaaaaagcuccgccccagaugguuggacgccaggaccuauuccgauccucuggcucuacgggaguucaaagaauuugccgcuggccgaagaagcgugucaggggaccugauccucgagauuggaaaacuuccgcagcaccugacuuuacgcgcacaaaaugccuuggauaaccuggugaugcuccacaauagugaacagggcgguaaggcuuacaggcaugccauggaggagcugccagacacgaucgaaacccuuaugcugcucgcauugauugcgguccugacagggggcguuacuuuauucuuucuaucuggaaagggccuggggaaaaccuccaucggacuccuuugugugauggccagcucaguacuguuguggauggcuaguguggagccccacuggauagccgcaagcaucauucuggaguucuuucucaugguccugcuuaucccugagcccgaucggcagcguacaccacaggacaaccaacucgcuuaugugguuauuggucuguuguucaugauccugaccguggccgcaaacgagaugggcuuacuagaaacuacaaagagagaucuggggauaggacaugucguagccgagaaucaccaccaugcuacgaugcucgacauugaucuucacccugcguccgccuggacccuguacgcaguggcuacuacaaucauuacccccaugaugaggcauaccaucgaaaacacaacugccaauauaucuuugacggccaucgcaaaccaggcugccauucugaugggccucgacaaggguuggccaaucagcaaaauggauauugggguuccucugcuugcguuaggcugcuacucccaggugaauccgcugacccucacagcugccgucuugaugcugguggcacacuaugccaucauaggacccggccuacaagcuaaggcaacucgcgaggcccagaaacggaccgcggcugggauuaugaagaacccaacagucgacggaaucguggccaucgaccuggauccuguuguguacgacgcaaaauuugaaaagcagcucggccagauuaugcuucugaucuuguguaccucacaaauacugcucaugcgaacuacgugggcccugugcgagucuauuacauuagcuaccgguccccuuacuacccugugggaggggaguccaggaaaguucuggaauacaacuaucgccguaucgauggcaaacauuuucagaggcagcuaucucgcuggugccggccuagcguuuucccugaugaaaucucuagggggaggcaggcgcgggaccggagcccagggcgaaacacugggugagaaguggaaacggcagcucaaucagcuuucaaagagcgaguucaacacguacaaaagauccgggaucauggagguggaucguagugaagcaaaggagggacugaagaggggcgagaccacuaaacaugcugucucucgggguacaguuaaguugcgcugguuuguggaacgaaaucuggucaaaccugagggcaaggugauagaccucggguguggaagaggcggguggagcuauuacugcgccggacugaaaaagguaaccgaagugaagggcuauacuaaaggugggcccggacacgaggaaccgaucccaauggcaacauacggcuggaacauuguuaagcuacacucaggcaaagauguguucuuuaccccucccgagaagugugacacgcuucugugcgauaucggggaguccaguccaaaucccaccauugaagagggaaggacacuacggguccucaaaaugguggaaccuuggcugcgcgguaaccaauucuguaucaagauuuugaauccguacaugcccagcgucguggagacucuggagcagaugcagagaaaacauggcgggaugcucguuaggaacccacuuucucgaaauuccacccacgaaauguauuggguaucaugcggaacaggcaacaucgugagcgcugucaacaugacuucgcggaugcuguuaaaucguuuuaccauggcccauagaaagccuacauacgagcgcgacguggaucugggugccgggaccaggcacguugcgguggaacccgagauagcuaacuuggacauuaucggacagcggaucgaaaauauuaagaacgagcacaaaucuacuuggcauuaugaugaggacaauccuuacaagacgugggcauaucacggcaguuacgaagucaaaccauccggcagcgccucauccauggugaacgggguagugagacuccugacaaagcccugggacguuauaccuauggucacccaaaucgcuaugacugauaccacaccauucggacagcagcgcguguuuaaagagaagguggacacgaggacaccccgaccgaagcgggguacugcccaaauuauggaagucacagcaaaauggcuauggggcuuccuuucuagaaauaagaaaccuaggaucuguacccgcgaggaauuuacucguaagguucggagcaacgccgcuauuggggcgguguucguagaugagaaucaguggaacagugccaaagaggcaguggaagacgagagauuuugggaucugguccauagggaacgcgagcuccacaagcagggaaagugcgcuacaugcguguauaauaugaugggcaaacgagaaaagaaacugggugaguucgggaaggccaaaggaucccgggcaaucugguacaugugguugggcgccagauuccuggaguuugaagcucucggcuucaugaacgaggaccauugguuuagcagggaaaauucucuuucagggguugagggagagggucuguacaaguuaggcuauauacugcgcgauaucaguaagauuccagggggaaacauguacgccgacgauaccgcgggcugggacacaagaaucacugaagaugacuugcagaaugaggcaaaaauuaccgauaucauggaacccgagcacgcccuccuggcuacguccauauucaagcuaaccuaucaaaacaaagugguccgggugcagaggccugccaagagcgguacaguaauggacguuauuucucgucgagaccagcgcgggucgggacaggugggcacuuacggccuuaacaccuuuacaaauauggaaguccaacugaucagacagauggagucagaggggaucuucagcccauccgaacucgagaacaguaaucuggcagaacggguguuggauugguuagagaaacacggaguggaaaggcugaagcgcauggcuauuucuggugacgauugugucguuaaacccacugacgauagauuugccaccgcucucacggcccuuaacgacaugggcaaggugcggaaggauauaccgcagugggagccuagcaaaggguggaaugacuggcagcaaguacccuucugcucccaucacuuucaucagcugaucaugaaggauggaagggagauuguggucccaugucgaaaccaggacgaguuagugggccgugcaagaguuucacagggugcgggguggagucugcgcgagacagccugccucggaaaaucuuaugcucaaauguggcaguugauguacuuccaccggagggaucugagacuugccgcaaaugcuaucuguagcgccgugccugucaacugggugcccaccucccgcacuacauggucaauucacgcacaucaccaguggaugaccacugaagacaugcugagcguauggaaucggguuuggaucgaggaaaacccauggauggaggacaagacccaugugucuuccugggaggauguccccuaucucggcaaaagggaagaccaauggugcggcaguuuaauagggcugacagcccgagcgacgugggcuaccaauauccagguggccauuaaccagguuagacgguugaucggaaaugagaacuacagcgauuacaugacuucgaugaagagguuuaagaaugaauccgacccugagggugcacugugguga

SEQ ID NO: 13217 - RNA, 9879 nt, Artificial Sequence
  derived and/or modified CDS sequence (opt3) from DENV-1__KX380796__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagaugcagaaaguggaaacuugggcucugcggcacccuggauucaccguuaucgcacuguuucucgcccaugcuauuggcacaucgaucacccagaagggcauuaucuucauauuacugaugcuugugacgccaucaauggccaugcgcugcgucgggaucggaaacagagauuuuguggaggguuugagcggcgcgacuuggguagacguugugcuggagcacgggaguugugucacaaccauggcaaagaauaaacccacucuagauauugaacuccugaagacagaggugaccaacccugccgugcuuaggaaacugugcaucgaagcuaagauuuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagacagugcaguacgaaaaccucaaauauuccgucaucgugaccguucacacuggagaucagcaucaaguggguaaugagacgacagaacacggcaccauagccacuauuaccccccaggcgccuacaucagagauccagcuuaccgacuacggggcccugacuuuggacuguaguccaaggacaggacuagauuucaacgaaaugguccugcucacgaugaaggagaaaagcuggcuggugcauaagcagugguuucuugaccugccguugcccuggaccucuggcgcauccacuucacaagagacauggaaucggcaggaucuccugguaaccuucaaaacagcucacgccaagaagcaggaaguuguggucuuagguagccaagagggggcuaugcacacugcccugaccggcgcaacggaaauucagaccaguggaacaacuaccaucuuugccggccaucuaaaaugccgucucaagauggacaaacugacacuuaagggggugucuuaugucauguguacuggauccuucaaauuggagaaggaaguggcugagacccagcacgguacgguucuggugcagguaaaguacgagggcacagaugcgccuugcaaaaucccauucagcacccaagacgaaaagggggucacucagaacggacgccucauuacagcaaaucccauagugaccgauaaagagaagccuguuaacaucgaaacugagccacccuuuggcgagucguauauugugaucggugccggggaaaaagcucugaagcuuucuugguucaagaaaggcuccucaauaggaaagauguuugaggccaccgcaagaggcgccaggcggauggcuauucugggggacacagccugggauuucggaaguaucgguggcgucuuuacgagcguggggaaauugguacaucagguguucggaaccgcauacggcguucucuuuaauggugucuccuggacuaugaagaucgggauuggcauccuguuaacauggcugggacuaaacucucgaagcaccucacucaguaugacauguauugcggugggcauggugacucuguaccuuggggucaugguucaggcugacuccggaugcgugauaaacuggaaaggccgcgaauugaagugugguagcgggaucuucgugaccaaugagguacacacguggacagaacaauauaaguuucaggccgauucuccgaaaagacugucagcagccauuggaaaggcuugggaggagggcgucugcgguaucaggagugccacccggcucgaaaacaucauguggaaacagauuagcaaugagcugaaccauauauuacuggaaaaugacaugaaguucacugugguugugggcgacgcaaacgggauccuuacccagggaaaaaagaugauucgcccucaacccauggagcacaaauacuccuggaagucuuggggcaaggcuaaaaucauuggggccgauacacagaauacuaccuuuaucauagacggaccagauacaccugaaugucccgacgaucagagagcguggaacaucugggaggucgaggacuauggcuucgguguguuuacgaccaauauuugguugaagcucagggauucguacacucagaugugcgaccaccgucugaugagcgccgcuaucaaagauuccaaggcaguucaugccgacaugggguauuggauugaaucagagaaaaacgaaacauggaagcuagcucgggccaguuucaucgaggugaagaccuguauauggccacgaucucacacucuguggagcaauggaguacucgaauccgagaugauuauccccaaaauuuacggcgguccuaucucacaacauaacuauagaccaggcuacuucacacagaccgcagggccguggcaccugggaaagcuugaguuggauuuugaccugugcgaaggcacgacugucgugguggaugagcacugcgggaauaggggacccagcuuacgcaccacaaccgucacuggcaaaauaauccaugaaugguguugccggucuuguacacucccuccacugagauucaggggugaggacgggugcugguacggaauggagauucgccccguuaaggaaaaagaggaaaaccuugugcgauccaugguaagugcgggcagcggugagguggacucuuuuucccugggcuugcucugugucucaaucaugauugaagaggugaugcggagucguuggagcagaaagaugcugaugaccgggacacuagccguuuucuuucugcucaucaugggacagcugacuuggaaugaucuuauaagguugugcauuauggugggcgcuaacgucucggaccgcauggggaugggaaccacguaucuggccuuaauggcaacauucaagaugcggccuauguuugcugugggccuccuguucagaaggcuuaccucccgagagguucugcuacucacuaucggucugucuuugguggccagcgucgaacugccaaacucauuagaggaacucggggauggacuggcaaugggcaucaugaugcuuaaacuguugaccgacuuucaaccccaccagcucuggacaacucugcuaagucugaccuucauuaagacgacacuuucccucgauuacgccuggaaaaccauggcuaugguacugucuaucgugagcuuguuuccgcuguguuuauccacuacaucacagaagaccacuuggcucccuguucugcuuggcagcuucgggugcaaaccacugacaauguuuuugauuaccgagaauaagauauggggacgcaagaguuggccccucaacgaagguaucauggcggugggcauugucucuauccugcuauccagccugcuuaaaaaugacgugccucucgccgggccccugauugcaggaggcauguugaucgcuuguuauguaauaucggguucaucugccgauuuaagucuggagcgggccgcugagguguccugggaagaggaagcagagcauagcggggccucucacaacauccucgucgaaguucaggacgauggaacgaugaagauuaaagacgaggagagagaugacacucugaccauccuucugaaggcgacauugcuagcugugagcggcguguacccaauguccauuccugccacccuguucgucugguauuucuggcaaaaaaagaaacagaggucaggcgugcucugggauacacccaguccaccggaaguugagcgugcaguacuggacgacgggaucuaccgcauacuucagcggggauuacuggguagaagccaggugggcgucgggguguuucaagauggaguuuuccauacuauguggcacgugaccaggggcgccguccucauguaucaggguaagcgauuggaaccuucuugggcuuccgugaagaaagaccugauuucauacgggggaggcuggcgguuucagggcaguuggaauacgggggaggagguacaggucaucgcaguggaacccggaaagaacccaaaaaauguucaaacaacucccgguaccuucaagacaccugagggcgaagugggggccaucgcgcucgauuuuaaaccaggaaccagcggcucccccauugucaaccgcgaggguaagauaguggggcuguacggaaauggcguugugacuaccucuggcacauaugucucggcuaucgcccaggcaaaggccagccaggaagggccucuuccggagauugaggacgaaguguucaaaaagagaaaccugacgaucauggauuugcacccaggaucagguaaaacuaggcgguaccuacccgcuauuguacgagaggccaucaagagaaaacugcgcacccucauauuagcaccuacaagggugguugcuuccgaaauggccgaggcgcugaagggcaugccaauccguuaucaaaccacugccgucaagagugaacauacagggaaagagauuguggaccuuaugugccacgcaaccuuuacgaugcggcugcucucucccgugagagucccuaauuacaacaugaucauuauggaugaggcucauuucacugacccggccagcaucgcugcaaggggauauauauccacacgcguaggcaugggugaagccgccgcuauuuuuaugaccgcgacccccccagggucaguggaggcauucccucagucuaaugccguuauccaggaugaagagcgagacauccccgaaagaagcuggaacaguggauacgauuggauuacugacuuuccaggcaagacagugugguucgucccuuccaucaaaagcggcaaugacauagcuaacuguuugcggaagaacgggaaaagggugauucagcugucucgcaagaccuucgauacagaguaucaaaagacuaaaaauaacgacugggauuacguugugacgaccgacaucucagagaugggagccaauuuucgugcagauagagucauugacccccggaggugccucaagccagugauccugaaagaugguccggaacgcguaauacuugccggcccuaugcccgugacagcugcguccgccgcacagcgaagagggcggauuggaaggaaccagaauaaggagggcgaccaguacaucuauaugggucaaccacuaaacaaugaugaagaccacgcucauuggacugaggccaaaaugcuguuggauaacaucaauacccccgaggggauuaucccugcauuauucgaaccagagcgcgaaaagagugccgcuauugacggcgaguacagacugaggggagaagcccggaagacauuuguugagcucaugcgucgcggcgaucugcccgucuggcuuagcuauaaaguggcgucggagggguuccaguacucugaccgaagauggugcuuugacggagaaaggaacaaucaggugcuggaggaaaacauggaugucgagauauggaccaaggaaggugagcggaaaaagcuccgcccuagaugguuggacgcaaggacuuauuccgauccgcuggcccuacgggaguucaaagaauuugcugccggccgaagaagcguuucaggggaccugauccucgagauuggaaagcuuccacagcaccugacguuacgcgcucaaaaugcauuggauaaccuggugaugcuccacaauagugaacagggcgguaaagccuacaggcaugcuauggaggaacugcccgacaccaucgagacacuuaugcugcucgccuugaucgcaguacugacugggggcgugaccuuauucuuucuaucuggaaagggccuggggaagacauccauuggacuccuuugugucauggcgagcucagugcuguuguggauggccaguguugagccucacuggauagcugccagcaucauucuggaauucuuucucauggugcugcuuauccccgagccagaucggcagcguaccccucaggacaaccaacucgcauaugucguaauuggucuguuguucaugauccugacuguggcugccaacgaaaugggcuuacuagagacaacgaaaaaggaucuggggauaggacauguuguggcagagaaucaccaccaugccaccaugcucgacaucgaucuucaccccgcuuccgcguggacucuguacgccgucgcaacaaccauuaucaccccaaugaugagacauacaauugaaaacacuacggcuaauaucucuuugaccgccauagccaaccaggcagcuauucugaugggccucgacaaagguuggccuaucagcaagauggauauuggggugccgcugcuugccuuaggcugcuacucccaggucaauccccugacacucacugcggcuguguugaugcugguugcccacuaugcaaucauaggaccaggccuacaagccaaagcuaccagggaggcacagaagcgcacagccgcggggaucaugaagaacccuaccguggacggaauuguagcuaucgaccuggaucccguggucuacgacgccaaauuugaaaagcagcucggccagauuaugcuucugaucuuguguacuucacaaauacugcucaugcggacgacaugggcacugugcgagucuauuaccuuagccacugguccacuuaccacacugugggaagggaguccuggacgauucuggaauacuaccaucgcuguuucgauggccaacaucuucagaggcagcuaucucgcaggugcuggccuagccuuuucccugaugaaaucuuuggggggaggcaggcgcgggacaggagcgcagggcgagacgcugggugagaaguggaaacggcagcucaaucagcuuucaaagagcgaauucaacaccuacaagagauccgggauuauggagguggaucguagugaagccaaagagggacugaagaggggcgaaacuacaaaacaugcagucucucgggguaccgcuaaguugcgcugguuuguggagcgaaaucugguaaaacccgagggcaaggugaucgaccucggguguggaagaggcggguggagcuauuacugcgccggauuaaagaaaguuacugaagugaagggcuauacaaaaggugggccgggacacgaggaaccaauaccuauggcaaccuacggcuggaacauugucaagcugcacucaggcagggauguguucuuuacgcccccagagaaaugugacacccuucugugcgauaucggggaauccagucccaauccuacaauugaggagggacggacucuacgcguccucaagaugguggaaccguggcugagagguaaccaauucuguaucaaaauauugaaucccuacaugccaagcguuguagagacccuggaacagaugcagaggaagcauggcgggaugcucgugcgaaacccucuuucucggaauuccacacacgagauguauugggucucaugcggaacuggcaacaucgugagcgcuguuaacaugaccucgcguaugcuguuaaauagauuuacaauggcccaucgcaagcccaccuacgagagggacguggaucugggugccgggacucggcacgucgcgguggaaccugagauugcuaacuuggacaucauuggacagagaaucgaaaauauuaaaaacgagcacaagucuacguggcauuaugaugaagacaauccauacaaaacaugggcauaucacggcaguuacgagguaaagcccuccggcagcgccucauccauggugaacgggguuguccgccuccugaccaaaccuugggacgugaucccaauggugacucaaauagcuaugaccgauacaacgcccuucggacagcagagggucuuuaaggagaagguugacacccgaacuccgcggccuaaaagagguacagcccaaauuauggaagugaccgcaaaguggcuauggggcuuccuuucuaggaauaaaaagccacgcaucuguacucgugaggaauuuacacggaaaguaagaagcaacgccgcuaucggggcgguguucgucgaugagaaucaguggaacagugccaaggaagcaguggaggacgagagguuuugggaucugguucaucgcgaacgagagcuccacaagcagggaaaaugcgcuaccugcguguauaauaugaugggcaagcgggaaaaaaagcugggugaguucgggaaagccaagggauccagagcaauuugguacaugugguugggcgccagguuccuggaauuugaggcucucggcuucaugaacgaggaccauugguuuagccgcgaaaauucucuuucaggggucgagggagaaggucugcacaaguuaggcuacauacugagagauaucaguaaaauucccgggggaaacauguaugccgacgauacagcgggcugggacacucggaucaccgaggaugacuugcagaaugaggcaaagauuacggauaucauggaaccugagcacgcccuccuggcuaccuccauauucaaacuaacauaccaaaacaaggugguaaggguucagcguccagccaaaagcgguacugugauggacgucaucucucgacgcgaccagagagggucgggacaggugggcaccuauggccuuaacacauuuacuaauauggaagugcaacugauucggcagauggagucagaagggaucuucagccccuccgagcucgagaacaguaaucuggcagaaagggucuuggauugguuagagaagcauggaguugaacgccugaaaagaauggcuauuucuggugacgauugugugguaaagccgaccgacgaucgguuugccacggcucucacagcccuuaacgacaugggcaaggugaggaaagauaucccucagugggagcccagcaagggguggaaugacuggcagcaagucccauucugcucccaccauuuucaccagcugauaaugaaagauggacgagaaauugugguuccuugucguaaccaggacgagcuagugggcagagcacgcgucucacagggugcgggguggagucugcgggagaccgccugccucggaaagucuuacgcucaaauguggcaguugauguauuuccacaggagagaucugcgccuugccgcaaaugcuaucuguagcgccgugcccguaaacuggguuccaacuucccggacaaccuggucaauccaugcacaccaucaguggaugacuaccgaagacaugcugagcguguggaauagggucuggauugaggaaaaccccuggauggaggacaaaacacacgugucuuccugggaagauguuccuuaccucggcaagcgagaggaccaauggugcggcaguuuaauagggcugacggccagagcgaccugggcuacuaauauccagguggccauuaaccagguccggagguugaucggaaaugagaacuaucuggauuacaugacaagcaugaagcgcuuuaaaaaugaaucggacccagagggugcacucugguga

SEQ ID NO: 13218 - RNA, 9879 nt, Artificial Sequence
  derived and/or modified CDS sequence (opt3) from DENV-1__KX380799__SS-prME
agcgugaccaugcugcucaugcuucugcccaccgcauuggcuuuccacuuaacuacgagaggaggggaaccucauaugaucgucuccaagcaagaaaggggaaaaucucuguuguuuaagaccucagccgguguuaacaugugcacacucauugcaauggaccugggcgaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaaaaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguauuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacaagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcagaagaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagaacgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccagcugucccgcaagacauucgacaccgaguaucaaaagacuaagaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaguacaucuauaugggucaaccccuaaacaaugacgaagaucacgcucauuggacagaggccaaaaugcuguuggacaacauuaauacuccagaggggauaauccccgcauuauuugaaccugagcgcgaaaagucggccgcuauugauggcgaguacagacugaggggagaagcccggaagaccuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggacaaaggaaggugagcggaaaaagcuccgccccagaugguuggaugcaaggaccuauucagacccucuggcccuacgggaguuuaaagaguucgcugccggccgaagaaguguuucuggggaucugauccucgagauuggaaaacuuccgcagcaccugacuuuacgcgcucaaaaugcauuggacaaccuggugaugcuccacaauuccgaacagggcgguaaagccuacaggcaugcuauggaggaacugccagauacgauagagacccuuaugcugcucgccuugaucgcaguacugacagggggcgugacuuuauuuuuccuaagcggaaagggccuggggaagaccucaauuggacuccuuugugucauggcgaguagcgugcuguuguggauggccuccguugagccccacuggaucgcugccucuauuauccuggaauuuuuccucauggugcugcuuauaccugagcccgaccggcagcguacaccacaggauaaccaacucgcauaugucguaaucggucuguuguuuaugauucugaccguggcugccaacgaaaugggcuuacuagagacuacuaaaaaggaccuggggaucggacauguuguggcagagaaucaccaccaugccacgaugcucgauauugaccuucacccugcuagcgcguggacccuguacgccgucgcaacuacaaucauaacccccaugaugagacauaccauugaaaacacaacugcuaauaucuccuugacggccauugccaaccaggcagcuauccugaugggccucgauaaagguuggccaauaucaaagauggacaucggggugccucugcuugccuuaggcugcuacucucaggucaauccgcugacccucacagcggcuguguugaugcugguugcccacuaugcaauuaucggacccggccuacaagccaaagcuacuagggaggcacagaagcgcaccgccgcggggauuaugaagaacccaacaguggauggaaucguagcuauagaccuggacccuguggucuacgaugccaaauucgaaaagcagcucggccagauuaugcuucugaucuuguguaccagucaaauccugcucaugcggacuacgugggcacugugcgagucgauuacauuagccaccgguccccuuacuacccugugggaagggagcccaggacgauuuuggaauacaacuaucgcuguuuccauggccaacauauucagaggcucuuaucucgccggugcuggccuagccuucucacugaugaaaagccuagggggaggcaggcgcgggaccggagcgcagggcgagacacugggugagaaguggaagcggcagcucaaucagcuuuccaagagugaauuuaacacguacaagagaucugggauuauggagguggaccguagcgaagccaaagagggacugaagaggggcgaaaccacuaaacaugcagucucacgggguacagcuaaguugcgcugguucguggagcgaaaucugguaaaaccugagggcaaggugaucgaucucggguguggaagaggcgggugguccuauuacugcgccggauuaaagaaaguuaccgaagugaagggcuauacuaaaggugggcccggacacgaggaaccgauuccaauggcaacauacggcuggaacaucgucaagcugcacaguggcagggacguguuuuucaccccucccgagaaaugugauacgcuucugugcgacauaggggaaagcucuccaaaucccaccaucgaggagggacggacacuacgcguccucaagaugguggaaccuuggcugagagguaaccaauuuuguauuaaaaucuugaauccguacaugcccuccguuguagagacucuggaacagaugcagaggaagcauggcgggaugcucgugcgaaacccacuuucacggaauagcacccacgagauguauugggucucgugcggaacaggcaacauugugucugcuguuaacaugacaagucguaugcuguuaaauagauucaccauggcccaucgcaagccuacauacgagagggauguggaccugggugccgggacccggcacgucgcgguggaacccgagaucgcuaacuuggauauuaucggacagagaauagaaaauauuaaaaacgagcacaaguccacuuggcauuaugacgaagauaauccuuacaaaacgugggcauaucacggcagcuacgagguaaagccaucaggcuccgccucuagcauggugaacgggguuguccgccuccugacaaaacccugggacgugaucccuauggugacccaaaucgcuaugacugacaccacaccauuuggacagcagagggucuucaaggagaagguugauacgcgaacaccccggccgaaaagagguacugcccaaauuauggaagugacagcaaaguggcuauggggcuuucuuaguaggaauaaaaagccucgcauauguacccgugaggaguucacucggaaaguaagauccaacgccgcuaucggggcgguguuugucgacgagaaucaguggaacagcgccaaggaagcaguggaggaugagagguucugggaccugguucaucgcgaacgagagcuccacaagcagggaaaaugcgcuacaugcguguauaauaugaugggcaagcgggagaaaaagcugggugaguuugggaaagccaagggaucuagagcaauuugguacaugugguugggcgccagguuccuggaguucgaggcucucggcuuuaugaacgaggaucauugguucucacgcgaaaauagucuuuccggggucgagggagaaggucugcacaaguuaggcuacauccugagagacauuagcaaaaucccagggggaaacauguaugccgaugacaccgcgggcugggauacacggauaacugaggacgauuugcagaaugaggcaaagaucaccgacauuauggaacccgagcacgcccuccuggcuacgucuaucuuuaaacuaaccuaccaaaacaaggugguaaggguucagcguccugccaaaucggguacagugauggaugucauuucacgacgcgaccagagagggagcggacaggugggcacuuauggccuuaacaccuucacaaauauggaagugcaacugauccggcagauggaguccgaagggauauuuaguccaucugagcucgagaacagcaaucuggcagaaagggucuuggacugguuagagaagcauggaguugaacgccugaaaagaauggcuauuuccggugaugacugugugguaaagcccacugaugaccgguucgccaccgcucucacggcccuuaacgauaugggcaaggugaggaaagacaucccgcagugggagccuucaaagggguggaaugauuggcagcaaguccccuuuugcagucaccauuuccaccagcugaucaugaaagacggacgagaaauugugguuccaugucguaaccaggaugagcuagugggcagagcacgcgucucucagggugcgggguggagccugcgggagacagccugccucggaaaguccuacgcucaaauguggcaguugauguauuuucacaggagagaccugcgccuugccgcaaaugcuauauguucagccgugccuguaaacuggguucccaccagccggacuacauggucuauccaugcacaccaucaguggaugaccacugaagauaugcuguccguguggaauagggucuggauugaggaaaacccauggauggaggacaaaacccacgugaguagcugggaagacguucccuaccucggcaagcgagaggaucaauggugcggcucguuaaucgggcugacagccagagcgacgugggcuaccaauauucagguggccaucaaccagguccggagguugauaggaaaugagaacuaucuggacuacaugacuuccaugaagcgcuucaaaaaugaaucugauccugagggugcacucugguga

SEQ ID NO: 13219 - RNA, 9879 nt, Artificial Sequence
  derived and/or modified CDS sequence (opt3) from DENV-1__KX380800__SS-prME
agcgugaccaugcugcucaugcuucugcccaccgcauuggcuuuccacuuaacuacgagaggaggggaaccucauaugaucgucuccaagcaagaaaggggaaaaucucuguuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccaucuuuuuccugcucaucaugggacagcugacauggaaugaccuuauuagguugugcaucaugguuggcgcuaacguguccgaucgcauggggaugggaacuaccuaucuggccuuaauggcaacguuuaagaugcggccuauguucgcugucggccuccuguuuagaaggcuuacaucucgagaggugcugcuacucaccauuggucugagcuugguugccucaguggaacugccaaacaguuuagaggaacucggggacggacuggcaaugggcauaaugaugcuuaaacuguugacugauuuccaaucccaccagcucuggaccacacugcuaucucugacuuuuaucaagaccacgcuuagccucgacuacgccuggaaaacaauggcuaugguccuguccauuguaucauuguucccccuguguuuaagcaccacaagucagaagacaaccuggcucccggugcugcuuggcucuuuugggugcaaaccucugacuauguucuugaucacagagaauaagauuuggggacgcaaguccuggccacucaacgaagguaucauggcgguuggcauagugagcauccugcuaucgucacugcuuaaaaaugaugucccccucgccgggccucugauugcaggaggcauguugaucgcuuguuaugugauuucugguaguuccgccgacuuaagccuggagcgggccgcugagguaucuugggaagaggaagcagagcauagcggggccucccacaacauccucguggaaguccaggaugacggaaccaugaagauaaaagaugaggagagagacgauacgcugacuauucuucugaaggcgaccuugcuagcuguuucaggcguguaccccaugaguaucccagccacacuguuugugugguauuucuggcagaagaagaaacagaggagcggcguccucugggacaccccuucucccccagaaguggagcgugcaguucuggaugacgggaucuaccgcauucuucagcggggauuacuggguagaucccagguaggcgugggggucuuccaagacggaguguuucauacaauguggcacguuacuaggggcgccgugcucauguaucaggguaagcgauuggaaccgucaugggcuagugucaagaaagaucugauaagcuacgggggaggcuggcgguuccagggcuccuggaauaccggggaggaggugcagguaaucgcagucgaaccuggaaagaaccccaaaaaugugcaaacgacaccagguacuuuuaagacccccgagggcgaaguuggggccauugcgcucgacuucaaaccuggaacaucuggcucgccaaucgugaaccgcgaggguaagauugucgggcuguacggaaauggcgugguuaccacuagcggcaccuaugugucagcuaucgcccaggcaaaggccucccaggaagggccccuuccugagauagaggaugaagucuuuaaaaagagaaaccugacaaucauggacuugcacccgggaagugguaaaacgaggcgguaccuaccagcuauugugcgagaggccaucaagagaaaacugcgcacucucauuuuagcacccaccaggguaguggcuucugaaauggccgaggcgcugaagggcaugccuauccguuaucaaacaaccgccguuaagagcgaacauacugggaaagagauagucgaucuuaugugccacgcaacauucaccaugcggcugcucuccccagugagagugcccaauuacaacaugauuaucauggacgaggcucauuuuacggauccugccucaaucgcugcaaggggauauauuucuacucgcgucggcaugggugaagccgccgcuaucuucaugacagcgaccccgcccgggagcguagaggcauuuccacagaguaaugccgugauacaggacgaagaacgagauauuccugaaagauccuggaacagcggauacgacuggaucaccgauuuccccggcaagacuguuugguuugugccaucuauuaaaucaggcaaugacaucgcuaacuguuugcggaagaacgggaaaagggucauacagcugucccgcaagacauucgacaccgaguaucaaaagacuaagaauaacgauugggacuacgugguuacuacggauauuagugagaugggagccaauuuccgugcagacagagugaucgauccucggaggugccucaagcccgucauccugaaagacgguccagaacgcgugauucuugccggcccgaugccuguaaccgcugcgagcgccgcacagcgaagagggcggaucggaaggaaccagaauaaggagggcgaucaguacauuuauaugggucaaccccuaaacaaugacgaagaucacgcucauuggacagaggccaaaaugcuguuggacaacauaaauacuccagaggggaucauucccgcauuauuugaaccugagcgcgaaaagucggccgcuaucgauggcgaguacagacugaggggagaagcccggaagaccuucguggagcucaugcgucgcggcgaccugccaguuuggcuuucuuauaaagucgcguccgagggguuucaguacagcgaucgaagauggugcuucgacggagaaaggaacaaucaggugcuggaggaaaacauggacguggagaucuggacaaaggaaggugagcggaaaaagcuccgccccagaugguuggaugcaaggaccuauucagacccucuggcccuacgggaguuuaaagaguucgcugccggccgaagaagugucucuggggaucugauucucgagauaggaaaacuuccgcagcaccugacuuuacgcgcucaaaaugcauuggacaaccugguuaugcuccacaauuccgaacagggcgguaaagccuacaggcaugcuauggaggaacugccagauacgaucgagacccuuaugcugcucgccuugauugcagugcugacagggggcguaacuuuauuuuuccuaagcggaaagggccuggggaagaccucaaucggacuccuuugugugauggcgaguagcguccuguuguggauggccuccguggagccccacuggauugcugccucuaucauacuggaauuuuuccucaugguucugcuuaucccugagcccgaccggcagcguacaccacaggauaaccaacucgcauauguggucauuggucuguuguuuaugauccugaccguagcugccaacgaaaugggcuuacuagagacuacuaagaaggaccuggggauuggacaugugguugcagagaaucaccaccaugccacgaugcucgauaucgaccuucacccugcuagcgcguggacccuguacgccguggcaacuacaauaauuacccccaugaugagacauaccaucgaaaacacaacugcuaauauuuccuugacggccaucgccaaccaggcagcuauacugaugggccucgauaaagguuggccaaucucaaagauggacauuggggucccucugcuugccuuaggcugcuacucucaggugaauccgcugacccucacagcggcugucuugaugcugguggcccacuaugcaaucauuggacccggccuacaagccaaagcuacuagggaggcacagaagcgcaccgccgcggggaucaugaagaacccaacaguugauggaauaguggcuauugaccuggacccuguaguguacgaugccaaauucgaaaagcagcucggccagaucaugcuucugaucuuguguaccagucaaauucugcucaugcggacuacgugggcacugugcgagucgaucacauuagccaccgguccccuuacuacccugugggaagggagcccaggaaaauuuuggaauacaacuauagcugucuccauggccaacauuuuccgaggcucuuaucucgccggugcuggccuagccuucucacugaugaaaagccuagggggaggcagaagggggaccggagcgcagggcgagacacugggugagaaauggaagcgccagcucaaucagcuuuccaagagugaauuuaacacguacaaacggucugggaucauggagguugacagaagcgaagccaaggagggacugaaacguggcgaaaccacuaagcaugcagugucaagggguacagcuaaauugcggugguucgucgagcgcaaucuggugaagccugagggcaagguaauugaucucggguguggacgaggcgggugguccuauuacugcgccggacugaaaaaggugaccgaaguuaaaggcuauacuaagggugggcccggacacgaggaaccgaucccaauggcaacauacggcuggaacauagugaaacuacacaguggcagagacgucuuuuucaccccucccgagaagugugauacgcuucugugcgacaucggggaaagcucuccaaaucccaccauugaggagggaaggacacuacgggugcucaaaauggucgaaccuuggcugcgcgguaaccaauuuuguaucaagauuuugaauccguacaugcccuccgugguugagacucuggaacagaugcagagaaagcauggcgggaugcucguaaggaacccacuuucacgaaauagcacccacgagauguauugggugucgugcggaacaggcaacaucgucucugcugugaacaugacaagucggaugcuguuaaaucguuucaccauggcccauagaaaaccuacauacgagcgcgauguugaccugggugccgggaccaggcacguggcggucgaacccgagauugcuaacuuggauaucauaggacagcggauugaaaauaucaagaacgagcacaaauccacuuggcauuaugacgaagauaauccuuacaagacgugggcauaucacggcagcuacgaggugaaaccaucaggcuccgccucuagcaugguaaacggggugguuagacuccugacaaagcccugggacgucaucccuauggugacccaaauugcuaugacugacaccacaccauuuggacagcagcgcguguucaaggagaaagucgauacgaggacaccccgaccgaagcgggguacugcccaaauaauggaaguuacagcaaaauggcuauggggcuuucuuaguagaaauaagaaaccuaggaucuguacccgcgaggaguucacucguaaggugcgguccaacgccgcuauuggggcgguauuuguggacgagaaucaguggaacagcgccaaggaagcagucgaggaugagagauucugggaccuggugcauagggaacgcgagcuccacaaacagggaaagugcgcuacaugcguuuauaauaugaugggcaaacgagaaaagaaacugggugaguuugggaaggccaagggaucucgggcaaucugguacaugugguugggcgccagauuccuggaguucgaggcucucggcuuuaugaacgaggaucauugguucucaagggaaaauagucuuuccgggguggagggagaaggucugcacaaauuaggcuacauucugcgcgacaucagcaagauaccagggggaaacauguaugccgaugacaccgcgggcugggauacaagaaucacugaggacgauuugcagaaugaggcaaaaauuaccgacaucauggaacccgagcacgcccuccuggcuacgucuauuuuuaagcuaaccuaccaaaacaaagucgugcggguacagaggccugccaagucggguacaguuauggaugugaucucacgucgagaccagcgcgggagcggacaggucggcacuuauggccuuaacaccuucacaaauauggaagugcaacugauaagacagauggaguccgaagggauuuuuaguccaucugagcucgagaacagcaaucuggcagaacggguguuggacugguuagagaaacauggagucgaaaggcugaagcgcauggcuaucuccggugaugacuguguugugaagcccacugaugacagauucgccaccgcucucacggcccuuaacgauaugggcaaaguacggaaggacaucccgcagugggagccuucaaaaggguggaaugauuggcagcaagugcccuuuugcagucaccauuuccaccagcugauuaugaaggacggaagggaaauagucgugccaugucgaaaccaggaugagcuaguuggccgugcaagagugucucagggugcgggguggagccugcgcgagacagccugccucggaaaauccuacgcucaaauguggcaguugauguauuuucaccggagggaccugagacuugccgcaaaugcuaucuguucagccgucccugugaacuggguacccaccagccgcacuacauggucuauucaugcacaccaucaguggaugaccacugaagauaugcuguccguuuggaaucggguguggaucgaggaaaacccauggauggaggacaagacccacgucaguagcugggaagacgugcccuaccucggcaagagggaggaucaauggugcggcucguuaauugggcugacagcccgagcgacgugggcuaccaauauccagguugccauaaaccaggugagacgguugaucggaaaugagaacuaucuggacuacaugacuuccaugaaaagguucaagaaugaaucugauccugagggugcacucugguga

SEQ ID NO: 13220 - RNA, 9879 nt, Artificial Sequence
  derived and/or modified CDS sequence (opt3) from DENV-1__KX380802__SS-prME
agcgugaccaugcugcucaugcuucugcccaccgcauuggcuuuccacuuaacuacgaggggaggggagccucauaugaucgucuccaagcaagaaaggggaaagucucuguuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggggaaacugacccuuaagggagugucuuaugucauguguacagguuccuucaaauuggagaaggaaguggcugagacucagcacggcaccguucuggugcagguaaaguacgaggggacggacgcgccuugcaaaauaccaaucagcacacaagaugaaaagggagucacccagaacggccgccucauuacugcaaaucccaucgugacagacaaagagaagccuguuaacauagaaaccgagccacccuucggugagucguauauugugaucggggccggcgaaaaagcucugaaacuuucuugguuuaagaaaggauccucaaucggcaagauguucgaggccacugcaagaggggccaggcggauggcuauucugggagauaccgccugggacuuugguaguaucggcggggucuucacaagcgugggaaaauugguacaucagguguuuggcacggcauacgguguucucuucuccggggucucuuggaccaugaagauuggcauaggaauccuguuaacuuggcugggccuaaauagccgaucaacaagucucuccaugaccuguauugcgguggggauggugacacuguaccuuggagucaugguucaggcugauagcggcugcgugaucaacuggaaaggucgcgaauugaagugugggucuggaaucuuugugacuaacgagguacacaccuggacggaacaauauaaguuccaggccgacucaccgaaaagacugagugcagccauuggcaaggcuugggaggagggugucugcggcauaaggagcgccacacggcucgaaaauaucauguggaaacagauuuccaacgagcugaaucauaucuuacuggaaaacgauaugaaguuuaccgugguugugggggacgcaaauggcauucuuacucagggcaaaaagaugauccgcccucaacccauggagcacaaauacucuuggaagucgugggggaaggcuaaaauaaucggagccgacacccagaacacaacuuucauuaucgauggcccagacaccccugaaugucccgaugaccagagagcguggaauauuugggaggucgaggauuaugguuuugggguguucacaacgaacaucugguugaagcucagggacagcuacacccagaugugcgaucaccgucugauguccgccgcuauaaaagacucaaaggcaguucaugccgauaugggauauuggauugaaagugagaaaaaugaaacuuggaagcuagcucgggccucuuuuaucgaggugaagacauguauuuggccacgaagccacacccugugguccaacggcguacucgaaucagagaugaucauacccaaaaucuacgguggcccuauuagccaacauaauuauagaccaggguacuucacucagacagcaggaccguggcaccugggcaaacuugaguuggacuucaaccugugcgaagggaccacggucgugguggaugagcacugcggaaauaggggccccucuuuacgcacuaccacagucaccgguaaaaucauucaugaaugguguugccgguccuguacucucccuccacugagauuuagaggggaagacggaugcugguacggcauggagauccgccccguuaaggaaaaagaggaaaaccuugugcgaaguaugguaagcgcggguucuggcgagguggauuccuucucacugggguugcucugugucaguauaaugauugaagaggugaugcggagccguuggucgagaaagaugcugaugacaggaacccuagccguauuuuuccugcucaucaugggccagcugacauggaaugaccuuaucagguugugcauuauggugggggcuaacgucuccgaccgcaugggaaugggcacuaccuaucuggccuuaauggcaacguuuaagaugcggccuauguucgcugugggucuccuguuuagaaggcuuacaucucgagagguucugcuacucaccaucgggcugagcuugguggccucagucgaacugccaaacaguuuagaggaacucggagauggccuggcaaugggcauuaugaugcuuaaacuguugacugacuuccaaucccaccagcucuggaccacacugcuaucucugacuuuuauaaagaccacgcuuagccucgauuacgccuggaaaacaauggcuaugguacuguccaucgugucauuguucccccuguguuuaagcaccacaagucagaagacaaccuggcucccgguucugcuugggucuuuuggaugcaaaccucugacuauguucuugauuacagagaauaagaucuggggucgcaaguccuggccacucaacgaaggcauuauggcgguggggaucgucagcauacugcuaucgucacugcuuaaaaaugacgugccccucgccggaccucugaucgcaggcgguauguugauugcuuguuauguaaucucugggaguuccgccgauuuaagccuggagcgggccgcugaggugucuugggaagaggaagcagagcauagcggagccucccacaacauucucgucgaaguucaggacgauggcaccaugaagaucaaagacgaggagagagaugacacgcugacuauacuucugaaggcgaccuugcuagcugugucaggcguguaccccaugaguauuccagccacacuguuugucugguauuucuggcagaagaagaaacagaggagcggggugcucugggauaccccuucucccccagaaguugagcgugcaguacuggacgauggaaucuaccgcauccuucagcgggguuuacugggcagaucccaggugggggucggaguguuccaagacggcguuuuucauacaauguggcacgugacuaggggugccguccucauguaucaggggaagcgauuggaaccgucaugggcuagugugaagaaagaccugauuagcuacggaggcggcuggcgguuccagggguccuggaauaccggagaggagguacaggucauagcaguggaaccugguaagaaccccaaaaauguucaaacgacaccaggcacuuuuaagacccccgagggggaagugggagccaucgcgcucgauuucaaaccuggcacaucugguucgccaauugucaaccgcgaggggaagaucgugggacuguacggcaauggcguugugaccacuagcgggaccuaugucucagcuauugcccaggcaaaggccucccaggaaggaccccuuccugagaucgaggacgaaguguuuaaaaagagaaaccugacaauaauggauuugcacccggguaguggcaaaacgaggcgguaccuaccagcuaucguacgagaggccauuaagagaaaacugcgcacucucaucuuagcacccaccagggugguugcuucugaaauggccgaggcgcugaaggggaugccuauucguuaucaaacaaccgccgucaagagcgaacauacuggaaaagagaucguggaccuuaugugccacgcaacauucaccaugcggcugcucuccccagugagaguccccaauuacaacaugauaauuauggaugaggcucauuuuacggacccugccucaaucgcugcaaggggcuauaucucuacucgcguagguaugggggaagccgccgcuauuuucaugacagcgaccccgcccggaagcguggaggcauuuccacagaguaaugccguuauccaggaugaagaacgagacauaccugaaagauccuggaacagcggcuacgauuggauuaccgacuuccccggcaagacugugugguuugucccaucuaucaaaucagggaaugauauugcuaacuguuugcggaagaacggaaaaagggugauccagcugucccgcaagacauucgacaccgaguaucaaaagacuaagaauaacgacugggauuacguugugacuacggacauaagugagaugggugccaauuuccgugcagauagagucauugacccucggaggugccucaagcccgugauccugaaagauggcccagaacgcguaauccuugccgggccgaugccugugaccgcugcgagcgccgcacagcgaagaggacggauuggcaggaaccagaauaaggagggugaccaguacaucuauauggggcaaccccuaaacaaugaugaagaccacgcucauuggacagaggccaaaaugcuguuggauaacauuaauacuccagagggcauaauccccgcauuauuugaaccugagcgcgaaaagucggccgcuauugacggagaguacagacugaggggcgaagcccggaagaccuucguugagcucaugcgucgcggggaucugccagucuggcuuucuuauaaaguggcguccgagggauuucaguacagcgaccgaagauggugcuucgauggugaaaggaacaaucaggugcuggaggaaaacauggacgucgagaucuggacaaaggaaggcgagcggaaaaagcuccgccccagaugguuggacgcaaggaccuauucagauccucuggcccuacgggaguuuaaagaguucgcugccgggcgaagaaguguuucuggagaccugauccucgagauuggcaaacuuccgcagcaccugacuuuacgcgcucaaaaugcauuggauaaccuggugaugcuccacaauuccgaacagggugggaaagccuacaggcaugcuauggaggaacugccagacacgauagagacccuuaugcugcucgccuugaucgcaguacugacaggcggagugacuuuauuuuuccuaagcggcaaggggcugggaaagaccucaauuggucuccuuugugucauggcgaguagcgugcuguuguggauggccuccguugagccccacuggaucgcugccucuauuauccuggaauuuuuccucauggugcugcuuauaccugagcccgaucggcagcguacaccacaggacaaccaacucgcauaugucguaaucggccuguuguuuaugauucugaccguggcugccaacgaaaugggguuacuagagacuacuaagaaggaucugggaaucggccauguuguggcagagaaucaccaccaugccacgaugcucgacauugaucuucacccugcuagcgcguggacccuguacgccgucgcaacuacaaucauaacccccaugaugagacauaccauugaaaacacaacugcuaauaucuccuugacggccauugccaaccaggcagcuauccugaugggucucgacaaaggguggccaauaucaaagauggauaucggcgugccucugcuugccuuaggaugcuacucucaggucaauccgcugacccucacagcggcuguguugaugcugguugcccacuaugcaauuaucggccccgggcuacaagccaaagcuacuagggaggcacagaagcgcaccgccgcgggaauuaugaagaacccaacaguggacggcaucguagcuauagaucuggacccuguggucuacgacgccaaauucgaaaagcagcucggucagauuaugcuucugaucuuguguaccagucaaauccugcucaugcggacuacgugggcacugugcgagucgauuacauuagccaccgggccccuuacuacccugugggaaggaagcccaggcaaauuuuggaauacaacuaucgcuguuuccauggccaacauauuccgagguucuuaucucgcaggcgcugggcuagccuucucacugaugaaauccuugggaggcgggagaaggggaaccggcgcgcagggugagacacugggggagaaauggaagcgccagcucaaucagcuuagcaagagugaauuuaacacguacaaacggucuggaauuauggagguggauagaagcgaagccaaggagggccugaaacguggugaaaccacuaagcaugcagucucaaggggcacagcuaaauugcggugguucguggagcgcaaucugguaaagccugaggggaaggugaucgaccucggauguggccgagggggaugguccuauuacugcgccggccuaaagaagguuaccgaagugaaagguuauacuaaagggggacccggccacgaggaaccgauuccaauggcaacauacggcuggaacaucgucaaacugcacagugggagagauguguuuuucaccccucccgagaagugugacacgcuucugugcgauauaggagaaagcucuccaaaucccaccaucgaggaggguaggacacuacggguccucaaaaugguggaaccuuggcugcgcggcaaccaauuuuguauuaagaucuugaauccguacaugcccuccguuguagagacucuggaacagaugcagagaaagcaugggggaaugcucgugaggaacccacuuucacgaaauagcacccacgagauguauugggucucgugcggcacagguaacauugugucugcuguuaacaugacaagucggaugcuguuaaaucguuucaccauggcccauagaaaaccuacauacgagcgcgacguggaucugggggccggaaccaggcacgucgcgguggaacccgagaucgcuaacuuggacauuaucggccagcggauagaaaauauuaagaacgagcacaaauccacuuggcauuaugaugaagacaauccuuacaagacgugggcauaucacggcagcuacgagguaaaaccaucaggguccgccucuagcauggugaacggaguugucagacuccugacaaagcccugggaugugaucccuauggugacccaaaucgcuaugacugacaccacaccauuuggucagcagcgcgucuucaaggagaaaguugacacgaggacaccccgaccgaagcggggcacugcccaaauuauggaagugacagcaaaauggcuauggggguuucuuaguagaaauaagaaaccuaggauauguacccgcgaggaguucacucguaagguacgguccaacgccgcuaucggagcgguguuugucgaugagaaucaguggaacagcgccaaggaagcaguggaggacgagagauucugggaucugguucauagggaacgcgagcuccacaaacagggcaagugcgcuacaugcguguauaauaugauggguaaacgagaaaagaaacugggggaguuuggaaaggccaagggcucucgggcaauuugguacaugugguugggcgccagauuccuggaguucgaggcucucggguuuaugaacgaggaccauugguucucaagggaaaauagucuuuccggagucgagggugaaggccugcacaaauuaggguacauccugcgcgauauuagcaagaucccaggaggcaacauguaugccgacgauaccgcggguugggacacaagaauaacugaggaugacuugcagaaugaggcaaaaaucaccgauauuauggaacccgagcacgcccuccuggcuacgucuaucuuuaagcuaaccuaccaaaacaaagugguacggguucagaggccugccaagucggggacagugauggacgucauuucacgucgagaucagcgcggaagcggccaggugggcacuuaugggcuuaacaccuucacaaauauggaagugcaacugaucagacagauggaguccgaaggaauauuuaguccaucugagcucgagaacagcaaucuggcagaacgggucuuggacugguuagagaaacaugguguugaaaggcugaagcgcauggcuauuuccggcgacgauugugugguaaagcccacugacgauagauucgccaccgcucucacggcccuuaacgacauggggaaagugcggaaggauaucccgcagugggagccuucaaaaggauggaaugacuggcagcaaguccccuuuugcagucaccauuuccaccagcugaucaugaaggauggcagggaaauugugguuccaugucgaaaccaggacgagcuagugggucgugcaagagucucucagggggcgggauggagccugcgcgagacagccugccucggcaaauccuacgcucaaauguggcaguugauguauuuucaccggagggaucugagacuugccgcaaaugcuauauguucagccgugccuguaaacuggguucccaccagccgcacuacauggucuauccaugcacaccaucaguggaugaccacugaagacaugcuguccguguggaaucgggucuggauugaggaaaacccauggauggaggauaagacccacgugaguagcugggaagacguucccuaccucggcaagagggaggaccaauggugcgggucguuaaucggacugacagcccgagcgacgugggcuaccaauauucagguggccaucaaccaggucagacgguugauagguaaugagaacuaucuggauuacaugacuuccaugaaaagguucaagaaugaaucugacccugagggcgcacucugguga

SEQ ID NO: 13221 - RNA, 9879 nt, Artificial Sequence
  derived and/or modified CDS sequence (opt3) from DENV-1__KX380797__SS-prME
agcgugaccguccugcucaugcuucugcccacugcauuggcuuuccacuuaacuacgcgaggaggggaaccucauaugaucguuuccaagcaggaaaggggaaaaucucugcuauuuaagaccucaacaggugugaauaugugcacucucauugcaauggaccugggcgaacuuugugaagauaccaugacauacaaaugcccacggauaaccgaaacugaaccggacgauguagacuguuggugcaaugccacagagaccugggugacguaugggacuuguagucaaaccggagagcaccgccgagauaagcguagcgucgcgcuggcuccccaugugggcuugggucucgaaacaaggacugagaccuggauguccucugaaggggccuggaggcagauccagaaaguugagacaugggcacugcggcacccuggauucaccgugauugcccuguuucucgcucaugcaaucggcacgucgauuacucagaagggcaucauauucaucuuacugaugcuugucacaccaucaauggccaugcgcugcguggggauuggaaacagagacuuuguagaggguuugagcggcgcuaccuggguugaugugguccuggaacacgggaguugugugacuacaauggccaaggacaaacccacccuagauaucgagcuccugaagacggaagugaccaauccugcgguccuuaggaaacugugcauugaggcaaagaucuccaacacaacuaccgacucucgguguccaacacaaggagaagccacuuugguugaggagcaggauaccaauuucgugugccgccgaacacucguagaccggggcugggguaacggguguggacuguuuggcaaaggcagcuuaauaaccugcgcuaaguucaagugcgugacuaaacuggaagggaagauuguccaguacgagaaucucaaauauuccgugaucguuacggugcacacaggagaucagcaucaagucgguaacgaaaccacugagcacggcaccacagccaccauuacuccccaggcaccuacaucagaaauccagcuuacggacuacggggcucugaccuuggacuguaguccaaggacuggacuagauuuuaaugagauggugcugcucacaaugaaggagaaaagcuggcugguacauaagcagugguuccuugaccugccguugcccuggaccucuggcgccuccacaucacaagaaacuuggaaccggcaggaucuccugguuaccuuuaaaacggcgcacgccaagaagcaggagguggucguguuagguagccaagaaggggcaaugcacaccgcucugacaggcgccacugagauccagaccaguggaacaacuaccauuuucgcuggccaucuaaaaugccgucucaagauggacaaacugacgcuuaagggggucucuuaugugauguguacaggauccuuuaaauuggaaaaggagguugccgagacccagcacgguacugugcugguacaggucaaguacgaaggcacagaugcaccuugcaaaauaccauucaccagccaagacgagaagggggugacucagaauggacgccucaucaccgccaaccccauuguuacagauaaagaaaagccugugaauaucgaggcugagccacccuucggcgaaucguaucuggucgugggugcgggggagaaagcacuuaagcugucuugguuuaagaaaggcuccucaauaggaaagauguucgaagccacggcuagaggcgccaggcggauggcaauuuugggggacaccgccugggauuuuggaaguaucgguggcguauucacuagcguggggaaacucauccaucagauuuuuggaacagcuuacggcguucuguucuccggugucucuuggaccaugaagaucgggauuggcauauuacugacauggcuaggacucaacagccgaucaacaagucuguccaugaccuguaucgccgugggcauggugacgcuuuacuugggggucaugguucaggcagacagcggaugcgugauuaauuggaaaggccgcgagcugaagugugguucugggaucuuugugacaaacgaaguacacaccuggacugagcaauauaaguuccaggcggauucaccgaaaagacucagugcugccaucggaaaggcaugggaggaaggcgucugcgguauuaggagcgccacccggcuggagaacauaauguggaaacagaucuccaaugaauuaaaccauauucugcuugagaaugacaugaaguuuacagugguugugggcgacgucaacgggaucuuggcucagggcaagaaaaugauucgcccucaacccauggaacacaaauacucuuggaagucguggggcaaggccaaagugaucggggcagauguucagaauagcacuuucauaaucgacggaccaaacaccccugagugucccgaugaccagagagcuuggaauauuugggagguggaagauuauggcuuugguaucuucacaacgaacauuuggcucaagcugagggacuccuacacccagguaugcgaucaccgucuaaugucagccgcgaucaaagacaguaaggccguccaugcugauaugggguauuggauagagucugagaagaaugagacuuggaagcugacacgggccagcuuuauugaagugaagaccuguguguggccaaaaucccacacucucuggucaaacggaguccuggagagcgagaugaucauucccaagaucuacggcgguccuauaucucaacauaauuaucgaccaggcuacuucacacagaccgccgggccguggcaccuuggaaaauuggaacuggacuucggcuuaugcgaggggacgacuguugugguagaugaacacugcggaaacagaggccccucccucaggaccacaaccgugacugguaagaucauucaugagugguguugccgcaguuguacacugccuccacuucgguuuaaaggggaggacggaugcugguacggcauggaaaucagacccgucaaggagaaggaagagaaucuggugaaaagcaugguuucugcugguuccggcgaaguggauucauucaguuuggggcuccuguguauuagcaucaugauagaggaggucaugaggucgcgcuggucccgaaagaugcuaaugaccggaacacuggccguguuucuccugcuuauuaugggccaguugacuuggaacgaccugauccgguuaugcaucaugguuggggcaaaugcgucugacaaaaugggaaugggcaccacguaucucgcccugauggcuacauuccguaugagaccuauguuugccgugggucuucuguucaggcgccuaaccagccgggaaguccuccugagaucaguaggguugagucugguggcauccguugaguuaccaaacucucucgaagaacugggagauggccuugcuaugggcauuaugaugcugaaguugcucacugacuuucaaagccaccagcugugggccgcacuacugucccuuaccuucgugaaaacaacuuuuucacuccauuacgccuggaagaccauggcuaugauccugagcauugucaguuuguucccccuguguuuaucuacgacaucccagaagaccacuuggcucccggugcugcuugggagccugggaugcaaaccuuugacaauguuucucauaaccgaaaacaagaucugggguaggaaaucguggccacugaaugagggcauuauggcgguagggaucgugucaauucuacugucuagucuucucaagaacgaugucccccuggccggaccuuugaucgcaggcgguauguuaauagcuuguuauguuaucuccgggagcucugccgaccugagccucgagaaagccgcugaaguguccugggaggaagaggcagaacacucaggagccagucauaauauucugguggagguccaggaugacggcacuaugaagaucaaagaugaggaacgagacgauacacuuaccauucuguugaaggcgacgcuacuggcuaucagcggcguguaccccaugucuauaccagccacucucuucguuugguauuuuuggcaaaagaaaaagcagcgcuccgggguacugugggacaccccuucacccccagagguggaacgggcaguccuugaugacggaauuuacagaaucuuacagaggggucugcucggcaaaagucagguggggguuggaguguuccaagagggcgucuuccacacaauguggcacgugacccguggugccguauugauguaucaggggaagcgccuggagccgagcugggcuuccgucaaaaaggaucucaucucuuacggaggcggcuggcgguuucaggggucguggaacacaggagaagaggugcagguuauugcaguggaaccugguaagaaucccaaaaacguccaaacugccccaggcaccuucaagacgcccgagggggaagugggagcgauagcucuggacuuuaaaccuggcacaagcgguucaccaaucguuaauagagaggggaagauugugggacuuuacggcaacggcgucgugacuaccuccgggacauauguaagugccaucgcacaggccaaggcuucucaggagggaccccugccugaaauugaggacgaaguguucaggaagcgaaauuugaccaucauggaucuacauccggguagcggcaagacucggcgcuaccugccagccauaguuagagaggcaaucaaaaggaagcuccggaccuuaguccuggcucccacacgagugguggccuccgaaauggcggaggcccuuaaagggaugccuauuagauaucaaacgacugcagucaagucagagcacaccggaaaagaaaucguagaccugaugugccaugcuacauuuaccaugcgccucuugucuccagugaggguucccaacuacaauaugauuaucauggaugaggcccacuucacugacccugcuagcauagcagcccguggcuauauuaguacacggguggguaugggggaagccgcugcgaucuuuaugaccgcaacgccgcccggauccauggaggccuucccacagagcaacgcugccauccaggaugaagagagagacauuccugagaggucuuggaacucaggcuacgauuggaucacugacuuucccggcaagacagucugguucgugccauccauaaagagugggaacgauauugcaaauugucugcgcaaaaacggaaagcgaguugugcagcucagcagaaaaaccuuugacaccgaauaucaaaagacuaaaaacaaugauugggacuacgucgugacaaccgacaucucggagaugggugccaacuuccgggcugauaggguaauugacccucgccguugccugaagcccgugauccuuaaggauggcccagaaagaguuauacuagcggggccgaugccugucacaguggccucugcagcucagcggaggggacgcauuggccgaaaucagaacaaagagggugaccaguacaucuauauggggcaaccccugaauaacgaugaggaccaugcccacuggacugaagcaaagauguuguuagauaauaucaacacgccagagggcauuauccccgcccuguucgaaccugagagagaaaaauccgcugccauugacggagaguaccggcucaggggcgaggcgcgcaagaccuuuguggaacugaugagaagaggggaucuuccagucuggcugagcuauaaaguugcaucagagggauuccaguacagugaccggcguuggugcuuugauggugaacgcaauaaccaggugcucgaggaaaauauggacguagagauauggacaaaggagggcgaaaggaaaaaguugagacccagauggcuggaugcccggacuuauucugacccucuagcucugcgcgaguucaaggaauuugccgcugggagaagguccgugagcggagaccucauccuugagauuggcaaacugccgcagcacuuaacccaacgggcacagaacgccuuggauaaucuggucaugcuccauaacucagaacagggugggaaggcuuaccgacacgccauggaggagcugccagacacaaucgaaacccuuaugcugcucgcauugaucgcggugcugacuggcggaguuacguuauucuuucuaaguggcagagggcugggaaaaaccagcauuggucuccuuugugugauggccuccucugcucuguuguggauggccagcgucgagccccauuggauagcagcuuccaucauucuggaguucuuucucaugguacugcuuaucccugagcccgaucgccagaggacaccacaagacaaucagcucgccuaugugguuauuggccuguuguucaugauccugacuguggcagccaacgagaugggguuacuagaaaccacaaagaaagaucugggaauaggccacgucgcugcggagucacaccaucacgccgcaaugcucgacguggaucuucauccugcuucugccuggacccuguacgccgucgcaacuacaaucauuacgcccaugaugcggcacaccaucgaaaacacuacagcuaauauuaguuugaccgccaucgcgaaccaggcugccauacugaugggucucgacaagggguggccaauuucgaagauggauaucggcgugccucugcuugcauuaggaugcuacagccaaguuaauccgcugacccucacagccgcuguguugaugcugguagcacauuaugccauuaucggccccgggcuacaggcgaaagcuacucgugaggcccagaagagaacggcagccggaauaaugaaaaacccaaccguggacggcaucgucgcuauugaucuggacccuguuguguacgaugccaaguuugaaaaacagcucggucaaaucaugcuucugauuuuguguacaucccagauccugcucaugaggacuaccugggcacugugcgagucuauaacauuagcuaccgggccccuuacuacgcugugggagggaucaccaggcaaguucuggaauacaaccauugccgucagcauggcgaacaucuuucgcgguuccuaucucgccggcgcagggcuagcuuucagucugaugaagucuuugggaggcgggcggcgaggaacuggcgcccagggugaaacccugggggagaaauggaagagacagcucaaucaacuuacaaaaagcgaguucaacacuuacaagaggucaggaaucauugagguggaccgcuccgaagcaaaagagggccugaagcggggugagaccacaaagcacgcuguaaguagaggcacggccaaauugcguugguuuguggaaaggaaucugguuaagccugaggggaaagugaucgaccucggauguggcagagggggauggagcuauuacugcgccggcuuaaagaaagucaccgaagugaaggguuauacuaaagggggacccggccacgaggaaccgauaccaauggcgacauacggcuggaaccuggucaaacuuuacucugggaaggauguguucuuuaccccucccgagaaaugugacacucugcuaugcgauauuggagaguccucaccaaaucccacaaucgaagagggucgcacccuccgaguucugaagaugguagaaccuugguugagaggcaaccaguucuguauuaaagugcugaauccguauaugcccagcgucguggagacgcucgagcagaugcagaggaagcaugggggaaugcuuguucggaacccacugucgcgcaauucuacccacgaaauguacugggugaguugcggcacagguaacaucgucuccgcugugaauaugacuagcagaauguuacugaacagguuuaccauggcacaucgaaaaccuacauaugagcgggacguagauuugggggccggaacucgucacguggcuguugaacccgaggucgccaaccucgacauaaucggccaaagaauugaaaauaucaagaacgagcacaagucaaccuggcauuacgaugaggacaauccuuauaaaacaugggcauaccacggcuccuaugaagugaagccaucugggagcgccaguuccauggugaacggagucguucgccugcuaaccaaacccugggaugugauuccuaugguaacucagaucgcuaugacggacacaaccccauucggucagcaaaggguguuuaaggagaaagucgauacucggacccccaaggcgaagagaggcacagcccagauuauggaagugacggcacgcuggcuuuggggguuccugagcaggaauaaaaagccgcgaaucuguacccgggaggaauuuacuagaaaaguuaggucuaacgcugccauaggagcaguguucgucgacgagaaucaguggaacucagccaaggaggcuguggaagacgagcgcuuuugggaucucguacaucgugaacgggagcugcacaaacagggcaagugcgccacaugcguuuacaauaugauggguaagagagagaaaaaguugggggaguucggaaaagcgaagggcaguagggcaauuugguacauguggcugggcgcccgcuuucucgaguucgaagcucuuggguucaugaacgaggaccauugguuuucccgagaaaauagccugucuggaguggagggugagggcuuacacaaacugggguauaucuugcgggauaucucgaagauuccuggaggcaacauguacgccgacgauaccgcagguugggacacuagaauaacagaagaugaccuccaaaaugaggcuaaaaucaccgauauuauggaaccagagcacgcccugcuagcuacaucaaucuucaaacuuacuuaucagaacaaggucgugagggugcagcgccccgccaaaaaugggaccgucauggacguuauuagcagacgggaucagaggggauccggccaagugggcacguacgggcugaacaccuuuacaaacauggaagcacagcucauccgucagauggagagugagggaauauuccugccuucugaauuggagacuccaaauuuagcggaacgaguacuggacuggcucgagaaguaugguaucgaacgccuuaaaagaauggccauuagcggcgaugacuguguggucaagcccguggacgaucgguuugcuaccgcccugacagcacuaaacgacauggggaaaguuaggaaggauaucccgcagugggagccuuccaagggauggaaugacuggcaacaggugcccuucugcucacaucacuuucaucagcugauuaugaaagauggccgcgagaucgucgugccauguagaaaccaggacgaacucguaggucgggcuaggguuagucaaggggccggauggucuuugcgagagacugcaugccugggcaagagcuacgcccagauguggcagcuuauguauuuccaccguagagaucugcgccucgcggcuaaugccauauguuccgcagugccugucgacugggugcccaccucacggacgacauggagcauucacgcccaucaccaauggaugaccacugaagauauguuaucuguuuggaacaggguguggaucgaggaaaauccauggauggaggacaaaacacaugucuccaguugggaggaugugcccuaccugggcaagagagaagaccaguggugcgggagcuugaucggacugaccgcucgcgccacuugggcaaccaacauucagguagcuauaaaucaggugcggaggcucaucgguaacgagaauuaccuugacuauaugacaucgaugaaacgauuuaagaacgaauccgauccugagggcgcccugugguga

SEQ ID NO: 13222 - RNA, 9879 nt, Artificial Sequence
  derived and/or modified CDS sequence (opt3) from DENV-1__KX380805__SS-prME
agcgugacaaugcugcucaugcuucugcccacagcauuggcuuuccacuuaacuacgagaggaggggaaccucauaugaucgucuccaagcaagaaaggggaaaaucucuguuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguuccguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucagugucagcauaaugauugaagaggugaugcggucgcguugguccagaaagaugcugaugacagggacccuagccguauuuuuccugcucaucaugggacagcugacauggaaugaccuuaucagguuguguauuauggugggcgcuaacgucucugaucgcauggggaugggaacuaccuaucuggccuuaauggcaacguuuaagaugcggccuauguucgcugugggccuccuguuuagaaggcuuacaagccgagagguucugcuacucaccaucggucugucauugguggccagugucgaacugccaaacuccuuagaggaacucggggacggacuggcaaugggcauuaugaugcuuaaacuguugacugauuuccaaucucaccagcucuggaccacacugcuaagccugacuuuuauaaagaccacgcuuucccucgacuacgccuggaaaacaauggcuaugguacugucaaucgugagcuuguucccccugugcuuaaguaccacuucucagaagacaaccuggcucccgguucugcuuggcuccuuuggguguaaaccucugacuauguucuugauuacagagaauaagaucuggggacgcaagagcuggccacucaacgaagguauuauggcggugggcaucgucucgauacugcuaucaucucugcuuaaaaaugaugugccccucgccgggccucugaucgcaggaggcauguugauugcuugcuauguaaucagugguuccagcgccgacuuaucucuggagcgggccgcugaggugagcugggaagaggaagcagagcauuccggggccucacacaacauucucgucgaaguucaggaugacggaaccaugaagaucaaagaugaggagagagacgauacgcugacuauacuucugaaggcgaccuugcuagcugugaguggcguguaccccaugagcauuccagccacacuguuugucugguauuucuggcagaagaagaaacagaggucuggcgugcucugggacaccccuucacccccagaaguugagcgugcaguacuggaugacgggaucuaccgcauccuucagcggggauuacuggguagaagccaggugggcgucgggguguuccaagacggaguuuuucauacaauguggcacgugacuaggggcgccguccucauguaucaggguaagcgauuggaaccgaguugggcuagcgugaagaaagaucugauuuccuacgggggaggcuggcgguuccagggcucuuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucgggcagcccaauugucaaccgcgaggguaagaucguggggcuguacggaaauggcguugugaccacuucaggcaccuaugucuccgcuauugcccaggcaaaggccagucaggaagggccccuuccugagaucgaggaugaaguguuuaaaaagagaaaccugacaauaauggacuugcacccgggaucugguaaaacgaggcgguaccuaccagcuaucguacgagaggccauuaagagaaaacugcgcacucucaucuuagcacccaccagggugguugcuagcgaaauggccgaggcgcugaagggcaugccuauucguuaucaaacaaccgccgucaaguccgaacauacugggaaagagaucguggaucuuaugugucacgcaacauucaccaugcggcugcucucaccagugagaguccccaauuacaacaugauaauuauggacgaggcucauuuuacggauccugccucuaucgcugcaaggggauauaucagcacucgcguaggcaugggugaagccgccgcuauuuucaugacagcgaccccgcccgggaguguggaggcauuuccacaguccaaugccguuauccaggacgaagaacgagauauaccugaaagaagcuggaacucuggauacgacuggauuaccgauuuccccggcaagacugugugguuugucccaucaaucaaauccggcaaugacauugcuaacugcuugcggaagaacgggaaaagggugauccagcugagucgcaagacauucgacaccgaguaucaaaagaccaagaauaacgauugggacuacguugugacuacggauauaagcgagaugggagccaauuuccgugcagacagagucauugauccucggaggugucucaagcccgugauccugaaagacgguccagaacgcguaauccuugccggcccgaugccugugaccgcugcgucggccgcacagcgaagagggcggauuggaaggaaccagaauaaggagggcgaucaguacaucuauaugggucaaccccuaaacaaugacgaagaucacgcucauuggacagaggccaaaaugcuguuggacaacauuaauacuccagaggggauaauccccgcauuauuugaaccugagcgcgaaaagucugccgcuauugauggcgaguacagacugaggggagaagcccggaagaccuucguugagcucaugcgucgcggcgaccugccagucuggcuuuccuauaaaguggcgagcgagggguuucaguacucagaucgaagauggugcuucgacggagaaaggaacaaucaggugcuggaggaaaacauggacgucgagaucuggacaaaggaaggugagcggaaaaagcuccgccccagaugguuggaugcaaggaccuauagugacccucuggcccuacgggaguuuaaagaguucgcugccggccgaagaucuguuuccggggaucugauccucgagauuggaaaacuuccgcagcaccugacuuuacgcgcucaaaaugcauuggacaaccuggugaugcuccacaauagcgaacagggcgguaaagccuacaggcaugcuauggaggaacugccagauacgauagagacccuuaugcugcucgccuugaucgcaguacugacagggggcgugacuuuauuuuuccuaucaggaaagggccuggggaagaccaguauuggacuccuuugcgucauggcgagcuccgugcuguuguggauggccucuguugagccccacuggaucgcugccagcauuauccuggaauuuuuccucauggugcugcuuauaccugagcccgaccggcagcguacaccacaggauaaccaacucgcauaugucguaaucggucuguuguuuaugauucugaccguggcugccaacgaaaugggcuuacuagagacuaccaaaaaggaccuggggaucggacauguuguggcagagaaucaccaccaugccacgaugcucgauauugaccuucacccugcuuccgcguggacccuguacgccgucgcaacuacaaucauaacccccaugaugagacauaccauugaaaacacaacugcuaauaucucauugacggccauugccaaccaggcagcuauccugaugggccucgauaaagguuggccaauaucuaagauggacaucggggugccucugcuugccuuaggcuguuacagucaggucaauccgcugacccucacagcggcuguguugaugcugguugcccacuaugcaauuaucggacccggccuacaagccaaagcuacuagggaggcacagaagcgcaccgccgcggggauuaugaagaacccaacaguggauggaaucguagcuauagaccuggacccuguggucuacgaugccaaauucgaaaagcagcucggccagauuaugcuucugaucuugugcaccucgcaaauccugcucaugcggacuacgugggcacugugugagagcauuacauuagccaccgguccccuuacuacccugugggaaggguccccaggaaaauuuuggaauacaacuaucgcuguuucuauggccaacauauuccgaggcucauaucucgccggugcuggccuagccuucagccugaugaagucccuagggggaggcagaagggggaccggagcgcagggcgagacacugggugagaaauggaagcgccagcucaaucagcuuaguaagucugaauuuaacacguacaaacggagcgggauuauggagguggacagaucagaagccaaggagggacugaaacguggcgaaaccacuaagcaugcagucuccagggguacagcuaaauugcggugguucguggagcgcaaucugguaaagccugagggcaaggugaucgaucucgggugcggacgaggcggguggaguuauuacugugccggacugaaaaagguuaccgaagugaaaggcuauacuaagggugggcccggacacgaggaaccgauuccaauggcaacauacggcuggaacaucgucaaacuacacagcggcagagacguguuuuucaccccucccgagaagugcgauacgcuucugugugacauaggggaaucuuccccaaaucccaccaucgaggagggaaggacacuacggguccucaaaaugguggaaccuuggcugcgcgguaaccaauuuugcauuaagaucuugaauccguacaugcccucaguuguagagacucuggaacagaugcagagaaagcauggcgggaugcucgugaggaacccacuuagccgaaauucgacccacgagauguauugggucucuuguggaacaggcaacauugugagugcuguuaacaugacuucccggaugcuguuaaaucguuucaccauggcccauagaaaaccuacauacgagcgcgauguggaccugggugccgggaccaggcacgucgcgguggaacccgagaucgcuaacuuggauauuaucggacagcggauagaaaauauuaagaacgagcacaaaagcacuuggcauuaugacgaagauaauccuuacaagacgugggcauaucacggcucauacgagguaaaaccauccggcucugccagcaguauggugaacgggguugucagacuccugacaaagcccugggacgugaucccuauggugacccaaaucgcuaugacugacaccacaccauuuggacagcagcgcgucuucaaggagaaaguugauacgaggacaccccgaccgaagcgggguacugcccaaauuauggaagugacagcaaaauggcuauggggcuuucuuuccagaaauaagaaaccuaggauaugcacccgcgaggaguucacucguaagguacggagcaacgccgcuaucggggcgguguuugucgacgagaaucaguggaacucugccaaggaagcaguggaggaugagagauucugggaccugguucauagggaacgcgagcuccacaaacagggaaagugugcuacaugcguguauaauaugaugggcaaacgagaaaagaaacugggugaguuugggaaggccaagggaucacgggcaauuugguacaugugguugggcgccagauuccuggaguucgaggcucucggcuuuaugaacgaggaucauugguucaguagggaaaauucccuuagcggggucgagggagaaggucugcacaaauuaggcuacauccugcgcgacauuucuaagaucccagggggaaacauguaugccgaugacaccgcgggcugggauacaagaauaacugaggacgauuugcagaaugaggcaaaaaucaccgacauuauggaacccgagcacgcccuccuggcuacgucgaucuuuaagcuaaccuaccaaaacaaagugguacggguucagaggccugccaagucagguacagugauggaugucauuagccgucgagaccagcgcggguccggacaggugggcacuuauggccuuaacaccuucacaaauauggaagugcaacugaucagacagauggagagugaagggauauuuucuccaagcgagcucgagaacuccaaucuggcagaacgggucuuggacugguuagagaaacauggaguugaaaggcugaagcgcauggcuauuucaggugaugacugcgugguaaagcccacugaugacagauucgccaccgcucucacggcccuuaacgauaugggcaaagugcggaaggacaucccgcagugggagccuaguaaaggguggaaugauuggcagcaaguccccuuuuguucucaccauuuccaccagcugaucaugaaggacggaagggaaauugugguuccaugccgaaaccaggaugagcuagugggccgugcaagagucagccagggugcgggguggucccugcgcgagacagccugucucggaaaaucauacgcucaaauguggcaguugauguauuuucaccggagggaccugagacuugccgcaaaugcuauaugcagcgccgugccuguaaacuggguucccaccucucgcacuacaugguccauccaugcacaccaucaguggaugaccacugaagauaugcugaguguguggaaucgggucuggauugaggaaaacccauggauggaggacaagacccacgugagcucgugggaagacguucccuaccucggcaagagggaggaucaaugguguggcuccuuaaucgggcugacagcccgagcgacgugggcuaccaauauucagguggccaucaaccaggucagacgguugauaggaaaugagaacuaucuggacuacaugacuucuaugaaaagguucaagaaugaaucagauccugagggugcacucugguga

SEQ ID NO: 13223 - RNA, 9879 nt, Artificial Sequence
  derived and/or modified CDS sequence (opt3) from DENV-1__KX380798__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccuggcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcuuaaguugagggauuccuauacacaggucugcgaccaccgucucaugucagcagccaucaaagauaguaaggcugugcacgccgacaugggguacuggauugaaucugagaaaaaugaaacguggaagcuggcacgggcgagcuucaucgagguuaagaccuguauauggccaaaaucccauacucuauggucaaacggagugcuggaaagcgagaugaucauucccaagaucuauggcgguccuauuucucaacacaauuaccgaccaggcuacuucacacagaccgccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggaaaaugcucaugaccgggacucuggccgucuuccuacugcucaucaugggacagcugacauggaacgaucuuauucguuugugcauaauggugggcgcaaaugcuucugacagaauggggaugggaaccacauaccuggccuuaauggcaacuuuuaagaugaggccuauguucgccguuggccuccuguuucgccggcuuaccagcagagaggugcugcuacucacgaucggucugucauuggucgcuaguguggaacugccaaacuccuuagaggaacucggggauggacuggcgaugggcauuaugauccuuaaacuguugacagacuuccaaucucaucagcucugggccacccugcuaagccugacuuuuauuaagaccacauucucccuucacuaugcauggaaaacuauggcuaugguucucucaaucgugagccuguuucccuugugucugaguaccacgucucagaagacaaccugguuaccgguccuccugggcucccuugggugcaagccucugacuauguucuugauagccgagaauaaaaucuggggaaggcgaagcuggccacucaacgaagguauuauggccguaggcaucgugucgauucugcuaucaucucugcuuaagaacgauguuccccucgcugggccucugaucgcaggaggcauguugauagccuguuacgugauuagugguuccagcgcggacuuaucucuggagaaagcugccgaggucagcugggaagaggaagcagagcauuccggggccucacacaauauccucguggaaguacaggaugacggaacaaugaagaucaaagaugaggagcgcgacgauacccugacuauucuucugaaggcuacauugcuagcagugaguggcgucuauccccugagcauaccagccacccucuuuguuugguacuucuggcagaaaaagaagcagcggucuggcgugcugugggacacgccuucacccccagaaguggagagagcgguccuugaugacgggaucuauaggauuaugcagcguggauuacugggucgcagccaggugggcguugggguauuccaagaaaacguguuucauacuauguggcacgucacccggggagcugugcucauguaccagggcaaaagauuggagccgaguugggccagcguuaagaaagaccugaucuccuacggugggggauggaggcuccagggcucuuggaauacaggcgaggaagugcaggucauugcaguggagccugggaagaaccccaaaaauguacaaaccgccccaggaacauucaagacucccgaaggugaggucggcgcuaucgcccuggauuuuaagccugggaccucgggaagcccaauagugaaccgagaaggcaaaaucguuggucuuuaugggaauggaguggucacgacaucaggcacuuacguguccgcaauugcucaggccaaggcgagucaggagggcccccugccugagaucgaagacgagguuuuccggaaacgcaacuugaccauuauggaucuacacccggggucuggaaagacaagaagguaucugccagccaucgugcgggaagcaauaaaacgaaagcucagaaccuuaauucuggcucccacucgcgucguggccagcgagauggcugaagcacuuaaggguaugccuaucagguaccaaaccacagccguaaaauccgagcauacgggcaaggagaucguggaccugaugugccacgccacuuuuaccaugcgucucuugucaccaguucggguccccaauuauaacaugauuaucauggaugaagcucauuucacagacccuucuagcauagcggcaagaggguacauuaguaccagggugggaaugggcgaggccgcugccaucuuuaugacugcaacaccgcccgguuccguggaagccuucccacagagcaaugcugucauucaggaugaggaacgcgacaucccugagcgaucuuggaacucaggguaugaguggauaaccgauuuucccggaaaaacgguaugguucgugccauccauuaagaguggcaaugacaucgcgaacugucugaggaaaaauggcaagcggguuauccagcucagcaggaagacuuuugauacagaauaccagaaaaccaagaacaacgacugggacuacguggucaccacugauauuucggagaugggggccaauuuccgcgcagaccgugugaucgauccuagacggugccugaaacccguuauucuuaaggacggaccagaaagggugauacuagcugguccgaugccugucacaguggccucugcagcccagcgccgaggcagaaucgggcggaaccacaauaaagagggagaucaguauauuuacaugggccagccccugaacaaugacgaggaucaugcucacuggaccgaagccaagauguuguuagacaacaucaauacaccagaggguaucauucccgcgcuguucgaaccugagagggaaaaguccgcagccauagauggggaguaucgccucagaggcgaggcuaggaaaacuuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacgaaagagggagaaaggaagaaauugcggccccgcuggcuggacgcuagaaccuacucugacccucuagcacugagggaguucaaggaauuugccgcuggucggcgauccgugagcggcgaucucauucuugagaucgggaaacugccgcagcacuuaacacagagagcccaaaaugcauuggacaaccuggucaugcuccauaauucagaacagggaggccgcgcguauaggcacgccauggaggagcugccagauacuauugaaacccuuaugcugcucgcuuugaucgccguucugacagguggggugaccuuauucuuucuaaguggccggggacugggcaagacuagcauagggcuccuuuguguaauggcauccucugugcuguuguggauggcuagcgucgagccccauuggaucgccgcauccauuauccuggaguucuuucucauggugcugcuuauuccugagcccgaccgucagagaacgccacaggauaaccaacucgccuacguugugaucggacuguuguucaugauacugaccgucgcugcgaaugagauggguuuacuagaaacaacuaagaaagaccugggcauugggcacguagccgugggaaaccaccaucacgcagcuaugcucgauguugaccuucauccugccucagccuggacccuguacgcaguggcuacaaccaucauuacucccaugaugaggcacacaaucgagaacacgaccgccaauauaucuuugacugcgaucgcuaaccaggccgcaauucugaugggccucgauaaggguuggccaaucaguaaaauggacauuggggucccucugcuugccuuaggcugcuauucgcaagugaauccgcugacacucaccgcugcagucuugaugcugguggcccauuacgcgaucauaggacccggccuacaagcuaaggccacccgcgaagcacagaaacggacagccgcugggauuaugaagaacccaacuguugauggaaucguggccaucgaccuggauccuguaguguaugacgcaaaguuugagaaacagcucggccagauuaugcuucugaucuuguguacgagccaaauacugcucaugcgaaccacaugggcucugugcgaauccauuacuuuagccaccgguccccuuacaacccugugggaggggucuccaggaaaguucuggaauacuacgaucgcggucucaauggccaacauuuuuagaggcagcuaccucgcaggagcuggccuagccuucucccugaugaaaagucuagggggaggcaggcgcgggacaggagcacagggcgagacccugggugaaaaguggaaacggcagcucaaucagcuuucuaagagcgaguucaacacuuauaagagaucagggaucauggaaguugaccguuccgaggcuaaagaaggacugaagaggggcgagaccacaaaacacgccgugagucgggguacugccaaguugcgcugguuugucgagcgaaaucuggugaaaccugaaggcaagguaauagaucucggguguggaagaggcggguggagcuacuauugcgcgggauuaaagaaagugaccgagguuaagggcuacacaaaaggugggcccggacacgaagaaccgaucccaauggcuacguacggcuggaaccuggugaaacuucauucuggcaaagacgucuucuuuauuccucccgaaaagugugauacccugcuaugcgacaucggggaguccucaccaaaucccacuauugaggaaggaaggacacuccgggugcugaaaauggucgagccuugguugcgcgguaaccaauucuguaucaagauucugaauccguauaugcccagcgugguugaaacccucgagcagaugcagagaaagcacggcgggaugcuuguaaggaacccacugucgcgaaauucuacucaugagauguacugggugaguugcggaacaggcaacaucgucuccgcagugaauaugaccagccggauguuacugaaccguuuuacgauggcccacagaaaaccuaccuaugaacgcgauguugacuugggugcugggacaaggcacguggccgucgagcccgaaguggcaaaccucgauauaauuggacagcggaucgagaauaucaagcaugaacacaaaucaacuuggcauuacgacgaggauaacccuuauaagaccugggccuaccacggcuccuaugagguaaaaccaucuggcagcgcuaguuccauggugaaugggguugucaagcugcuaacaaagcccugggacgugauuccuauggugacucaaauagcgaugaccgauacaaccccauucggacagcagagagucuuuaaagaaaagguugacacucgcacgcccaaagccaagagggguacagcacaaaucauggaggugaccgcuaaauggcuuuggggcuuccugagccgaaacaagaagccgcggauuuguacuagagaagaguuuaccaggaaaguacgcucuaaugccgcaaucggggccguguucgucgacgaaaaccaguggaacucagcuaaggaggccguggaggaugaacguuuuugggaccucguucauaaagagcgggaacugcacaagcagggaaaaugcgcgacaugcguguacaacaugaugggcaagagagagaagaaauugggugaguucgggaaggcaaaaggaaguagggccauuugguacauguggcugggcgcucgcuuucucgaguucgaggcccuuggcuucaugaaugaagaucacugguuuucccgagagaacagccugucuggggucgaaggagaggguuuacauaagcugggcuauaucuugcgggacauaucgaaaaucccugggggaaauauguacgcagaugacacggcuggcugggauaccagaauuacugaggacgaucuccagaacgaagccaggaucacagacauuauggagccagaacacgcucugcuagccaagucaaucuucaaacuuaccuaucaaaauaaggugguacgcguucagagacccgcaaagaacgguacugugauggaugucauaagccggagggaccagcguggguccggacaggugggcacauacggccugaauaccuuuacaaacauggaggcgcaacucauucgacagauggaaagugaggggaucuucucuccuagcgagcuggaaacuccaaacuuggccgagcgcguguuagauuggcuggaaaaauauggagucgagagacucaagcggauggcuaucuccggugacgacuguguugugaaacccauugaugacagguuugccaccgcacuuacggcucugaaugauaugggcaagguacgcaaagacauaccgcagugggaaccuucaaagggguggaacgauuggcagcaagugcccuucugcagucaucacuuucaccagcuaaucaugaaggacggaagagagauugucgugccaugucggaaucaggaugagcugguuggcagggcccgagugucucagggugcaggguggagccuccgugaaaccgccugcuugggaaaauccuacgcgcaaauguggcagcugauguauuuccauagacgcgaccuucggcuggcugccaacgcaaucuguucagccgucccuguggauuggauucccacaagcaggacuaccuggucuauccacgcucaucaccaguggaugacaacugaggacaugcucuccguauggaauagaguuuggauagaagagaacccauggauggaagauaagacccauaucaguagcuggggcgacgugcccuacuuaggcaaacgcgaggaccaauggugcgggucgcugauuggauugacggcccgggcaacaugggcuaccaauauccaggucgccauuaaccaggugaggcgacugaucgguaaugagaacuaccucgauuauaugacuuccaugaagagauuuaaaaaugaaucugacccugagggcgcgcuuugguga

SEQ ID NO: 13224 - RNA, 9879 nt, Artificial Sequence
  derived and/or modified CDS sequence (opt3) from DENV-1__KJ649286__SS-prME
agcgugaccaugcugcucaugcuucugcccacagucuuggccuuccacuuaacuacgcgaggaggggagccucauaugaucguuaccaagcaggaaaggggaaaaucccugcuauuuaagacaucuacuggugugaacaugugcacccucauugcuauggaccugggcgagcuuugugaagauacaaugaccuacaaaugcccacggauaacugaggcagaaccggacgauaucgacuguuggugcaaugccacagauaccuggguaacguaugggacuuguucacaaaccggagagcaccgccgagacaagcguagcguggcgcuggcuccccaugucggcuugggucucgagacaagaacugaaaccuggaugagcuccgagggggccuggaaacagauucagaggguggaaacaugggcacugcggcacccuggauucaccguuacggcccuguuucucgcucaugcaaucggcacuucuauuacacagaagggcaucauauucaucuuacugaugcuugugaccccaucgauggccaugcgcugcgucgggauuggaaacagagauuuuguggaggguuugucaggcgcuacuuggguagacguugugcuggagcacgggagcugugucacaaccauggccaaggauaaacccacgcuagacaucgaacuccugaagaccgaggugacaaauccugcggugcuuaggaaacugugcauugaagcaaagaucaguaacacuaccacagauucccgguguccaacucaaggagaggccaccuuggucgaagaacaggacgcuaauuucguuugccgccgaacauuuguggauagaggcugggguaacggguguggacucuucggcaaaggcucucugauaaccugcgccaaguuuaagugcguaacuaaauuagaggggaagauugugcaguacgaaaaucugaaauauagcgucaucgugacgguucacacaggagaccagcaucaaguggguaacgaguccaccgaacacggcacuaccgcaacaauuacaccccaggcuccuacuucagagauccagcucacagacuacggggcccuuacgcuggauuguaguccaaggaccggauuggacuucaaugaaaugguccuacugacuaugaaggagaaaagcuggcucgugcauaagcagugguuucuggaucuuccgcugcccuggacaucuggcgcgaccacaucccaagagacuuggaaccggcaggacuugcucguaaccuucaaaacggcccacgcaaagaagcaggaaguugugguccuggguucacaagagggggcuaugcacaccgccuuaacaggcgcuacugaaauccagaccagcggaacaacuaccauuuuugccggccaucugaaaugccgucuaaagauggauaaacucacgcugaaggggaugaguuaugugauguguacaggaucuuucaaacuugagaaggaagucguggagacccagcacgguacuguuuuggugcagguaaaguacgagggcacagacgcaccuugcaaaauaccauuccugacccaagaugaaaagggggucacucagaauggacgcgugaucaccgccaaccccauuguuacagacaaagagaagccugugaauaucgaagcugagccacccuuuggcgaguccuauauagucgugggugcgggggaaaaagcacucaagcugagcugguucaagaaaggcucgacgauuggaaagauguuugaggccaccgcuagaggcgccaggcggauggcaauccuuggggauacugccugggacuucggaucuaucgguggcguauuuacauccguggggaaacugguucaucagauuuucggaaccgcuuacggcgucuuguuuucaggugugaguuggacaaugaagaucgggauuggcgugcuccugacuugguuaggacugaacagccgauccaccucucuaagcaugacguguauagccgucggccucguuacacuguaccuuggggugauggugcaggcagauucaggaugcguaaucaauuggaaaggccgcgaauugaagugugguagugggauuuucgucaccaacgaggugcacacuuggaccgaacaauauaaguuucaggcggacuccccgaaaagacugagcgcugccaucggaaaggcaugggaggagggcguuugcgguaucaggucugccacacggcucgaaaacauuauguggaaacagauaucaaaugagcugaaccauaucuuacuggaaaaugacaugaaguucacuguggucgugggcgauguuagugggauucuugcucagggcaagaagaugauccgcccucaacccauggagcacaaauacagcuggaaguccuggggcaaggccaaaauuaucggggcagacgugcagaacucuaccuuuauaaucgauggaccaaauacaccugaaugucccgacgaucagagagcuuggaacauuugggagguagaggacuauggcuucgguaucuuuacgaccaauauuugguugaagcucagggauucguacacucaggucugcgaccaccgucugaugagcgccgcgaucaaagauuccaaggccgugcaugcugacaugggguauuggauagaaucagagaaaaacgaaacauggaagcuagcacgggccaguuucauugaggugaagaccugugucuggccaaaaucucacacucuguggagcaauggaguucucgaauccgagaugaucauucccaagaucuacggcgguccuauaucacaacauaacuaucgaccaggcuacuucacacagaccgcugggccguggcaccugggaaaacuugaguuggauuuugaccugugcgaaggcacgacugugguaguggaugagcacugcgggaauagaggacccagcuuaaggaccacaaccgucacuggcaagaucauucaugaaugguguugccgcucuuguacacucccuccacugcgguucaaaggugaggacgggugcugguacggaauggagaucagacccgugaaggaaaaggaggaaaaccuuguuaaauccauggugagugccggcagcggugaggucgacucuuuuucccugggcuugcucuguauuucaaucaugauagaagaggugaugaggagucgcuggagccgaaagaugcugaugaccgggacacuagcaguuuuccugcuccugauuaugggacagcuuacuuggaaugauuugauccggcugugcaucauggugggcgcgaacgccucggaccguauggggaugggaaccacguauuuagcucucauggccacauuuaaaaugagaccuauguucgcagucggccugcuuuuuaggcgccugaccucccgggagguacuacuccugacuauugguuugucucugguggcuagcguugaauuaccaaauucacucgaggaacugggggauggacuugccaugggcaucaugauucugaaguugcucaccgacuuccaaagucaccagcugugggcagcccuacugucccuuacauuuauaaaaacuaccuguucucuccauuacgcuuggaagacgauggcgauggugcugagcaucgucuccuuguucccccugugcaugucaacaaccagccagaagacuacaugguuaccggugcuccugggcagucuuggguguaaaccucugaccauguuuuugauugccgagaacaagaucuggggaagaaaaucuuggccacucaacgaagguauuauggcaguaggcaucguguccauacugcuaagcucgcugcuuaagaaugaugucccccucgcugggccucugguugccggaggcauguugaucgccugcuaugugauuucagguucuagugcugacuuaucccuggagaaagcagccgaggugagcugggaagaggaagcggagcacucuggggcuagccauaacauccucgucgaagugcaggaugacggaacuaugaagauuaaagaugaggagagggacgauacacugaccauccuucugaaggccacguugcuagcaguuuccggcguauacccccugucaauaccagccacucucuucgugugguauuuuuggcaaaagaaaaagcagcgaaguggcguccugugggacaccccuagucccccagaaguggagcgcgcuguucuugaugacgggauuuaccggaucaugcagagaggauuacuggguaggucucaggugggcgucgggguguuccaagaaaauguauuccacacaauguggcacgucacccguggagcagugcucauguauaaaggcaagcgcuuggagccgacaugggccuccguuaaaaaggaccugaucucauacggugggggauggcggcuccagggcaguuggaacacuggcgaggaagugcaggucauugcgguggagccugggaagaaucccaaaaacguucagaccgcuccaggaacguuuaagacacccgaaggugaggugggcgccauagcacuggauuucaaaccugggacuagcggauccccaaucgucaauagagaaggcaagauugugggucuuuacgggaacggaguagugaccacaucuggcaccuauguuucggccaucgcucaagccaaagcaagccaggagggcccccugccugagauugaagacgaggucuuuaggaagcgaaauuugacuaucauggaucuacauccggggucaggaaagacccggcgcuaccugccagcuauagugagagaagccaucaaaaggaagcuccggacauuaauucuggcgcccacgcgaguggucgccuccgagauggcagaagcucuuaaagguaugccuaucagauaucagacuaccgccguaaagagugagcacacaggcaaagagauuguggaccugaugugucaugcuaccuucacuaugcgccucuugucuccaguuagggugcccaacuacaauaugaucauaauggaugaagcacacuuuacagacccuagcuccauugccgcccguggguauaucucaacccgggucggaaugggcgaggcugcggcaaucuucaugacggccacuccgcccgguucuguggaggcuuuuccacaaagcaacgccguuauucaggaugaggaaagagacaucccugagaggaguuggaacuccggguacgauuggauaacagacuuccccggaaagaccgugugguuugucccaagcauuaagucuggcaacgauaucgcaaauugccugcgcaaaaacggcaagcgagugauucagcucucaagaaaaaccuucgacacugaguaucagaagaccaaaaauaaugacugggauuacguagugaccacagacaucuccgaaaugggggccaacuuucgggcugauaggguuauagacccucgccguugccugaagcccgucauucuuaaggauggaccagagagagugauccuagcggguccgaugccugugacugucgccagugcagcucaacggaggggccgcaucgggcgaaaucagaacaaagaaggagaccaguacauuuauaugggccagccccugaauaacgaugaggaccaugcccacuggacggaggcaaagauguuguuagauaauaucaacaccccagaagguauuauacccgcccuguucgagccugaaagagagaaaagcgcugccaucgacggggaauaccggcucaggggcgaggcgcgcaagacauucguugagcugaugagaaggggagaucuuccaguguggcugucguauaaaguagcaucugaaggcuuucaauacuccgaccggcguugguguuucgauggggagcgcaauaaccaggugcucgaagagaauauggacgucgaaauuuggacuaaggagggagagaggaaaaaguugagacccagauggcuggacgcccggaccuauagcgauccucuagcucugcgcgaauuuaaggaguucgccgcugguagaaggucagugaguggcgaccucauccuugaaaucgggaaacugccgcagcacuuaacacagcgggcacaaucugccuuggauaaccugguuaugcuccauaauuccgagcagggaggccgagcuuacagacacgccauggaggaacugccagacaccauugagacucuuaugcugcucgcauugauagcggugcugacggguggggucaccuuauuuuuccuaagcggcaagggacugggcaaaacaucaaucgggcuccuuugcguaauggccaguagcaugcuguuguggauggcuuccguggaaccccauuggauugccgcaucuaucauucuggaguuuuuccucaugguucugcuuaucccugaacccgaucgccagaggacuccacaggacaaccaacucgcuuauguggucauaggacuguuguuuaugauccugaccguggccgcaaaugagauggguuuacuagagacaaccaagaaagaucugggcauugggcacgucgccguggaaaaccaccaucacgcuacuaugcucgacguugaucuucauccugcgagcgccuggacacuguacgcaguggcuacgaccaucauuacucccaugaugcggcacacaaucgagaacaccaccgccaauauauccuugacagccauugcaaaccaggcugccauccugaugggacucgacaagggcuggccaauuucaaagauggauaucgguguaccucugcuugcguuaggguguuacucucaggugaauccgaugacucugacggcugccguccucauguugguugcacauuauaccauaaucggccccggacugcaagccaaagcuacacgugaagcacagaagagaacugccgcgggcauuaugaaaaacccaaccguggacgggaucgucgcuauugaucuagacccugugguauacgacgccaaguucgagaaacagcugggacagaucaugcuccuuauacugugcacaagucaaauuuugcugaugaggaccacuugggcacucugugaaucgaucacgcuggccacaggccccuuaaccacucuuugggaggguagcccagggaaguuuuggaauaccacaaucgcuguguccauggccaacauuuuccgcggaucuuaucuggcaggcgcuggucucgccuuuucacuaaugaaaagccugggcgggggacggcgaggcacuggggcgcagggagagaccuugggcgaaaaauggaagagacagcugaaucagcucuccaaaagugaguucaacacauacaagaggucugguaucauagaaguugaucgcagcgaggccaaagaagggcuuaagcggggagagacgaccaagcacgcagugucaagaggcacugcuaaacugcguugguucgucgagaggaauuuggugaagccugaagguaaagucauugaccugggcugcgggcggggaggcugguccuauuacugugccgggcucaagaaagugacagagguuaagggauauaccaaaggcggugcagggcacgaggaacccaucccgauggcuacuuacggauggaacuuaguaaagcugcauaguggcaaggauguguuuuucauuccaccugaaaaaugcgacacacuucugugugauaucggcgagagcucucccaauccaaccauagaggaagggcgcacgcuacgaguccucaagaugguggagcccuggcugagaggaaaccaauuuugcaucaaaauuuugaauccuuacaugccguccguuguggaaacccuggagcagaugcagaggaagcacgguggcaugcucguccggaacccccuuucacgcaauagcacacaugagauguauugggugucgugugggacuggaaacaucguaucugccgugaauaugaccaguagaaugcuguuaaacagguucacaauggcccaccgaaaaccaacuuacgaacgggacguugaucugggcgcggguacccgucacgucgcuguggagccugaaguggcaaacuuggacauuaucgggcagagaauugagaauaucaagcaugaacacaaguccacauggcauuaugaugaggacaaccccuacaaaaccugggccuaucacggaagcuacgaggucaagccuucaggcuccgcuucuagcaugguuaauggcgugguacgccuccugacuaaaccaugggaugugauacccauggucacgcaaauugccaugacagacaccacuccuuuugggcagcagaggguguucaaggaaaaaguugacacccggacaccaaaggcaaagagaggaacggcccaagugauggaggucaccgcucgcuggcuaugggguuuucuuaguaggaacaaaaagccccgaaucugcacucgggaagaguucacaagaaaagugagguccaaugcggccaucggcgcaguauuuguugaugaaaaccaguggaauagcgcuaaggaggccguggaggacgaacgcuucugggaucugguccaucgugagcgggaacuccacaaacaggggaagugcgcaaccuguguguauaacaugaugggaaagagagagaaaaagcugggcgaauuugguaaagccaaggggucuagggcuauuugguacaugugguugggagcccgcuuccuggaguuugaggcgcucggcuucaugaaugaagaccacugguucucacgagagaacagucuuuccggcguggaaggggagggacugcaucgguuagguuacauacugagagauaucagcaaaauuccgggcgggaauauguaugcagacgauacugccggaugggacacaaggaucaccgaggaugacuugcagaacgaagcuaagauuacagauaucauggagccugaacacgcccuccuggcaacuucuauauuuaaacuaaccuaccaaaauaaggucguucgcgugcagagaccagcuaagaacggcacgguaauggacgugaucucgcggagggaucagcgugguucagggcaggucggaaccuauggccuuaauacauucacuaacauggaggcccaacugauucgacagauggaaagcgagggccucuuuucccccagugagcuggaaaccccuaacuuggcugagcgcguguuaaauuggcuggggaaauacggaguugaaagacucaagcggauggccaucucuggugacgacugcguggucaaaccaauugaugacagguucgcaacagcgcuuacugcccugaacgauaugggcaaggugcgcaaagacaucccccagugggagccgagcaagggguggaaugauuggcagcaaguaccuuuuuguucccaucacuuccaccagcuaauaaugaaggacggaagagaaauuguugugcccugccggaaccaggaugagcuggucggcagggcucgagugucacagggugccggguggagucuccgugagaccgcauguuugggaaaaucuuaugcucaaauguggcagcugauguacuuucauagacgcgaccuucggcuggccgcaaaugccaucugcagcgcgguuccaguggauugggucccuacguccaggacaaccuggucaauccacgcucaucaccaguggaugacuacagaaaacaugcucagcguguggaauagaguauggauugaggaaaaccccuggauggaggacaagacccaugugucuuccugggaagaugucccauauuuaggcaaacgcgaggaccaaugguguggcagucugauaggguugacugcccgggcaaccugggccacaaauauccagguugcuauuaaccaggugaggaagcugaucggaaaugagaacuaccucgacuacaugacgagcaugaaacgauucaagaaugauucggaccccgaaggugcccuuugguga

SEQ ID NO: 13225 - RNA, 9879 nt, Artificial Sequence
  derived and/or modified CDS sequence (opt3) from DENV-1__KF887994__SS-prME
uccgugaccaugcugcucaugcuuaugcccacagcccuggcuuuccacuugacuacgagaggaggggagccucauaugaucgucuccaagcaagaaagaggaaaaucuuuacuguuuaagaccucagcggguguuaauaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacugcucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagaugcuggaggcaacugccagaggcgcuaggcggauggccauccuuggggauaccgcaugggacuuuggaagcauugguggcguguucacauccguugggaaacuggugcaucagauauuuggaacggcguacggcgucuuguucucuggugugagcuggaccaugaagaucgggauuggcguacuccugacuugguuaggacuaaauucacgaaguacaucccuaagcaugaccuguaucgcugugggccucguuacacuguaccuuggggucauggugcaggccgauucuggaugcgugaucaacuggaaaggccgcgaauugaagugugguucagggauuuuugucacuaaugagguucacaccuggacggaacaauauaaguuccaggcagacaguccgaaaagacugagcgccgcuauaggaaaggccugggaggagggcgugugcgguaucagguccgcaacacggcucgaaaacauuauguggaaacagaucucuaacgagcugaaucauauuuuacuggaaaacgacaugaaguuuaccgugguagucggcgauguggcugggauccuugcccagggcaaaaagaugauacgcccucaacccauggaguacaaauauucguggaaaagcuggggcaaggcgaagaucauuggggccgacguucagaauacuaccuucaucauugauggaccaaacacaccugaaugucccgacgaucagagagcuuggaauaucugggagguggaggacuacggcuuugguauauucacuaccaacauuugguugaagcucagggauuccuauacacaggucugcgaccaccgucugaugucagcagccaucaaagauaguaaggcugugcacgccgacaugggguacuggauugaaucugagaaaaaugaaacguggaagcuagcacgggcgagcuuuaucgagguuaagaccuguauauggccaaaaucccauacucuguggucaaacggagugcucgaaagcgagaugaucauucccaagaucuauggcgguccuauuucucaacacaauuaccgaccaggcuacuucacacagaccgccgggccguggcaucugggaaaacuugaguuggauuucgaccugugcgaaggcacuacaguagucguggaugagcacugcgggaacagaggacccuccuuaaggaccacgacugugaccggcaagaucauacacgaaugguguugccgcaguuguacacucccuccacugcgguuuagaggugaggacgggugcugguauggaauggagauuaggcccgucaaagaaaaggaggaaaaucuuguuaagagcauggugucugcuggcuccggugagguagacucauucagucugggcuugcucuguaucagcaucaugauugaagaggugaugcgcucgcgauggucccggaaaaugcugaugaccgggacucuagccgucuuucugcuccugaucauuggacagcuuacauggaacgauuugauacgucugugcaucauggugggcgcaaaugcuucugacagaauggggaugggaaccacauacuuagcccucauggcaacuuucaagaugaggccuauguuugccguuggccugcuuuuccgccggcugaccagcagagaggugcuacuccugacgauugguuugucacugauggcuagugucgaauuaccaaacucccucgaggaacugggggauggacuugcgaugggcaucaugauucugaaauugcucacagacuuucaaucucaucagcugugggccacccuacugagccuuacuuucaucaagaccacauuuucccuccacuaugcauggaaaacuauggcuauggugcugucaauaguuagcuuguucccccuguguuuaaguaccacgucucagaagacaaccuggcucccggugcugcuuggcucccuggggugcaagccuuugacuauguuucucaucgccgagaauaaaauuuggggaaggcgaagcuggccacugaacgaagguaucauggccgucggcauuguaucgauccuacugucaucucuucucaagaacgaugugccccuggcugggccuuugauagcaggaggcauguuaauugccuguuacguuaucagugguuccagcgcggaccugucucucgagaaagcugccgaggugagcugggaagaggaagcagagcauuccggggccucacacaauauccuggucgaagugcaggaugacggaacaaugaagauuaaagaugaggagcgcgacgauacccuuacuauacuguugaaggcuacacuacuggcaguaaguggcguguauccccucagcaucccagccacccuguucgucugguacuuuuggcagaaaaagaagcagcggucuggcguucuuugggacacgccuucacccccagaaguggagagagcgguguuagaugacgggauuuauaggaucaugcagcguggacugcucggucgcagccaggucggcguggggguuuuccaagaaaacguauuccauacuauguggcacgugacccggggagcugucuugauguaccagggcaaaagacuggagccgaguugggccagcgugaagaaagaccucauuuccuacggugggggauggaggcugcagggcucuuggaauacaggcgaggaaguucaggugaucgcagucgagccugggaagaaccccaaaaaugugcaaaccgccccaggaacauuuaagacucccgaaggugagguaggcgcuauagcccuugauuucaagccugggaccucgggaagcccaaucgucaaccgagaaggcaaaauugugggucuguaugggaauggaguugugacgacaucaggcacuuacgucuccgcaaucgcucaggccaaggcgagucaggagggccccuugccugagauugaagacgagguguuucggaaacgcaaccuaaccaucauggaucugcacccggggucuggaaagacaagaagguaucucccagccauaguucgggaagcaauuaaacgaaaguuaagaacccugauccuugcucccacucgcguggucgccagcgagauggcugaagcacugaaggguaugccuaucagguaccaaaccacagccgugaaauccgagcauacgggcaaggagauuguagaccucaugugccacgccacuuucaccaugcguuugcugucaccagugcggguucccaauuauaacaugaucauaauggaugaagcucauuuuacagacccuucuagcauugcggcaagaggguacaucaguaccagggucggaaugggcgaggccgcugccauuuucaugacugcaacaccgcccgguuccguggaagccuuuccacagagcaaugcugugauccaggaugaggaacgcgacauaccugagcgaucuuggaacucaggguaugaguggauuaccgauuuccccggaaaaacggucugguuuguaccauccaucaagaguggcaaugacaucgcgaacugucucaggaaaaauggcaagcgggugauucagcugagcaggaagacuuucgauacagaauaccagaaaaccaagaacaacgacugggacuacguugugaccacugauaucucggagaugggggccaauuuucgcgcagaccgugucauugauccuagacggugccuuaaacccgugauacuaaaggacggaccagaaaggguuauccuggcugguccgaugccugugacagucgccucugcagcccagcgccgaggcagaauugggcggaaccacaauaaagagggagaucaguauaucuacaugggccagcccuugaacaaugacgaggaucaugcucacuggaccgaagccaagauguuacuggacaacaucaauacaccagaggguauuauacccgcacucuucgaaccugagagggaaaaguccgcagccaucgauggggaguaucgccugagaggcgaggcuaggaaaacuuucguggaacuuaugcggcguggagaccugccaguauggcucagcuacaagguggccucagagggcuuucaauauagugaucgccgauggugcuucgacggggaaagaaacaaucagguuuuggaggaaaacauggaugucgagauuuggacgaaagagggagaaaggaagaaacugcggccccgcuggcuagacgcuagaaccuacucugacccucuggcacucagggaguuuaaggaguucgccgcuggucggcgauccgugagcggcgaucuuauccuggagauugggaaauuaccgcagcacuugacacagagagcccaaaaugcacuggacaaccucgugaugcugcauaauucagaacagggaggccgcgcguauaggcacgccauggaggagcuuccagauacuaucgaaacccugaugcucuuggcucugauagccgucuuaacaggugggguuacccuauuuuuccugaguggccggggacucggcaagacuagcaucgggcuucugugugugauggcauccucuguauugcuguggauggcuagcguggagccccauuggauugccgcauccaucauucucgaauuuuuccugaugguccuucucaucccugagcccgaccgucagagaacgccacaggauaaccaacuggccuacgugguuauaggauugcuguuuaugauuuuaaccguggcugcgaaugagaugggucuacuggaaacaacuaagaaagaccucggcaucgggcacgucgccguaggaaaccaccaucacgcagcuaugcuugauguggaccugcauccugccucagccuggaccuuguacgcaguugcuacaaccauuaucacucccaugaugaggcacacaauagagaacacgaccgccaauaucucucugacugcgauugcuaaccaggccgcaauccucaugggccuggauaaggguuggccaauuaguaaaauggacaucggggugccucuuuuagcccugggcugcuauucgcaggucaauccgcucacauugaccgcugcagugcugaugcuagucgcccauuacgcgauaauuggacccggccugcaagcuaaggccacccgcgaagcacagaaacggacagccgcugggaucaugaagaacccaacuguggauggaaucguugccauugaccucgauccugugguauaugacgcaaaguucgagaaacagcuuggccagaucaugcuguugauacuguguacgagccaaauucuccugaugcgaaccacaugggcuuuaugcgaauccaucacucuugccaccgguccccugacaacccucugggaggggucuccaggaaaguuuuggaauacuacgauugcggugucaauggccaacaucuucagaggcagcuaccuagcaggagcuggccuggccuuuuccuugaugaaaagucuagggggaggcaggcgcgggacaggagcacagggcgagacccucggugaaaaguggaaacggcagcuuaaucagcugucuaagagcgaguucaacacuuauaagagaucagggauaauggaagucgaccguuccgaggcuaaagaaggauugaagaggggcgagaccacaaaacacgccguuagucgggguacugccaagcugcgcugguucguggagcgaaaucucgucaaaccugaaggcaaggugaucgauuuaggguguggaagaggcggguggagcuacuauugcgcgggacugaagaaaguaaccgaggugaagggcuacacaaaaggugggcccggacacgaggaaccgauuccaauggcuacguacggcuggaaccuuguuaagcugcauucuggcaaagacguguuuuucaucccucccgaaaagugugauacccuacucugcgacauuggggaguccucaccaaaucccacuaucgaggaaggaaggacacugcgggucuugaaaaugguggagccuuggcugcgcgguaaccaauuuuguauuaagauccucaauccguauaugcccagcgucguggaaacccuugagcagaugcagagaaagcacggcgggaugcugguuaggaacccauuaucgcgaaauucuacucaugagauguacuggguaaguugcggaacaggcaacauaguguccgcagucaauaugaccagccggaugcuguugaaccguuucacgauggcccacagaaaaccuaccuaugaacgcgauguggaccucggugcugggacaaggcacguugccguggagcccgaagucgcaaaccuggauauuaucggacagcggaucgagaauauuaagcaugaacacaaaucaacuugguacuaugacgaggauaacccuuacaagaccugggccuaucauggcuccuacgaggugaaaccaucuggcagcgcuaguuccaugguaaauggggugguuaagcuacuuacaaagcccugggacgucauaccuauggugacucaaaucgcgaugaccgauacaaccccauuuggacagcagagaguguucaaagaaaaggucgacacucgcacgcccaaagccaagagggguacagcacaaauuauggagguuaccgcuaaauggcuguggggcuuucucagccgaaacaagaagccgcggaucuguacuagagaagaguucaccaggaaagugcgcucuaaugccgcaauuggggccguauuuguggacgaaaaccaguggaacucagcuaaggaggccgucgaggaugaacguuucugggaccuggugcacaaagagcgggaauugcauaagcagggaaaaugcgcgacaugcguuuacaacaugaugggcaagagagagaagaaacugggugaauuugggaaggcaaaaggaaguagggccaucugguauauguggcucggcgcucgcuuccuugaguuugaggcccugggcuucaugaaugaagaucacugguucucccgagagaacagcuuuucugggguggaaggagaggguuuacacaagcugggcuacauauugcgggacaucucgaaaauuccugggggaaauauguaugcagaugacacggcuggcugggauaccagaaucacugaggacgaucuccagaacgaagccaggauuacagacaucauggagccagaacaugcucugcuagccaagucaauauucaaacuuaccuaccaaaauaaggucgugcgcguacagagacccgcaaagaacgguacuguuauggauguggucagccggagggaccagcguggguccggacaggugggcacauauggccugaauaccuuuacaaacauggaggcgcaacucauucgacagauggaaagugaggggaucuucucuccuagcgagcuggaaacuccaaacuuggccgagcgcguguuagcuuggcuggaaaaauacggagucgagagacucaagcggauggccaucuccggugaugacuguguugugaaacccauugacgauagguuugcaaccgcucuuacggcccugaaugacaugggcaagguacgcaaagauauaccgcagugggaaccuucaaagggguggaacgacuggcagcaagugcccuucugcagucaccauuuucaccagcuaaucaugaaggauggaagagagauugucgugccaugucggaaucaggacgagcugguuggcagggcacgagugucucagggugccggguggagccuccgugaaaccgcgugcuugggaaaauccuaugcucaaauguggcagcugauguacuuccacagacgcgaucuucggcuggccgcaaacgccaucuguucagcugucccugugaauuggauucccacaagcaggacuaccuggucuauccaugcccaccaucaguggaugacaacugaggacaugcucuccguauggaacagaguuuggauagaagagaauccauggauggaagauaagacccacaucaguagcuggggcgacgugcccuacuuaggcaaacgcgaggaucaauggugcgggucgcugauuggauugacggcacgggcuacaugggccaccaacauccaggucgcgauuaaucaggugaggaagcugaucgguaacgagaauuaucucgacuacaugacuuccaugaaacgauuuaagaacgaaucugacccugagggcgcucuuugguga

SEQ ID NO: 13226 - RNA, 9879 nt, Artificial Sequence
  derived and/or modified CDS sequence (opt3) from DENV-1__JQ675358__SS-prME
agcgugacaaugcugcucaugcuucugcccacagcauuggcuuuccacuuaacuacgcgaggcggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaggagcuggcugguccauaaacaaugguuucuugaccugccguugcccuggacgucuggcgcauccaccucacaggagacuuggaaucggcaggaucuccuggugacauucaagaccgcucacgccaaaaagcaagaaguaguuguguuagguagccaggagggggcuaugcacacagcccugacuggcgcaaccgaaauucagacgaguggaaccacaacuauauuugccggccaucuaaagugccgucucaaaauggacaagcugacccuuaaagggacaucuuaugucauguguacuggauccuucaaguuggagaaagaaguggcugagacccagcacgguacgguccuggugcaaguuaaguacgagggcacagaugcgccuugcaagaucccauucagcacccaggacgaaaaaggggugacucagaacggacgccucauuacagcaaaucccaucguaaccgauaaggagaaaccugucaacauagaaacugagccacccuuuggcgagucguauauugugguuggugccggggaaaaggcucugaaacuuucuugguucaagaagggcuccucaaucggaaaaauguuugaggccaccgcaagaggcgccaggcggauggcuauccugggggacacagccugggauuucggaaguauugguggcguguuuacgagcgucgggaaguuggugcaucagguauucggaaccgcauacggcgugcucuuuuccgguguuucuuggacuaugaaaaucgggauuggcauacuguuaacauggcugggacuaaauagccgaucaaccagucucuccaugacauguaucgcggucggcauggugacucuguaccuuggggugaugguccaagcugacagcggaugcguuauuaacuggaagggccgcgaauugaaaugugguucugggaucuucgugaccaacgaggugcacacguggacagaacaguauaaguuucaggccgauucaccgaagagacugagugcagccaucggaaaggcuugggaggagggcguaugcgguauuaggagcgccacccggcucgaaaauauaauguggaagcagaucuccaacgagcugaaucauauuuuacuggaaaacgacaugaaauucacugucgugguuggcgacgcaaaugggauccuugcucaaggaaagaaaaugauucgcccucagcccauggagcacaaguacucuuggaaaucguggggcaaggccaagaucauaggggcggauauccagaacaccacauuuauuaucgacggaccagauacuccugaaugucccgacaaucagagagccuggaacauuugggagguggaggauuauggcuucgguaucuuuaccacaaauauaugguugaaacucagggacagcuacacgcaaaugugcgaucaccgucugauguccgcugcaauuaaggacucaaaagccguccaugcugauaugggguauuggaucgaaagugagaagaacgaaaccuggaaacuagcccgggcaucuuucauugaggugaagacuuguacauggccaaagagccacacccugugguccaauggaguucucgaaucagagaugaucauacccaaaacuuacggcgguccuaucagccagcauaacuaucgaccaggcuacuucacacagaccgcggggccguggcaccugggaaaacuugaguuggacuuugaucugugcgaaggcacgacugugguagucgacgagcacugcgggaauagaggacccucuuuaaggaccacaaccgugacuggcaaaauuauccaugaaugguguugccgcuccuguacacucccuccacugcgguucagaggugaggaugggugcugguacggaauggagauuaggcccgugaaggaaaaagaggaaaaccuuguccgcaguaugguuagcgccggcucuggugagguggacuccuuuucacugggcaucuugugugcuaguauaaugauugaagagguaaugcgaagccgguggucgcguaagaugcucaugaccgggacacuggccguguuccuacugcucaucaugggacaacugacuuggaaugaccuuaucagauugugcauuauggucggcgcaaacgcuuccgauaggauggggaugggaaccacguaucuggccuuaauggcaacauuuaagaugcgcccuauguucgccgugggccuccuguuucggagacuuaccucuagggagguucugcuacucacuaucggucugagcuugguggcuucagucgaacugccaaacaguuuagaggaacucggggacggacuggcgaugggcauuaugaugcuuaaacuguugaccgaguuccagccccaccagcucuggacaacucugcuaucccugaccuuuauaaagacgacacuuucucucgauuacgccuggaaaaccacugcaauggcucugagcaucguguccuuguucccgcuguguuuaucaacaaccagccagaagacuacauggcucccuguucugcuuggcaguuuugggugcaaaccacugaccauguucuugauuacggaaaauaagaucuggggacgaaagucuuggccccucaacgaggguauuauggccaucggcauagugucccugcuacugagcucgcuucucaaaaaugacgucccucuggccgggcccuugaucgcuggaggcauguuaauugcauguuauguaaucucagguucuagugccgaucugucccucgagaaggcggcugaagugagcugggagcaagaagccgagcauucugggacuagccacaacauucugguugaagugcaggacgauggaaccaugaaaaucaaggacgaggagcgcgaugacacacuuaccauacuggucaaagcaacauugcuagccguguccggcguauacccaaugucaauuccugcuacucuguuugugugguauuucuggcagaagaaaaagcagcggaguggcguccucugggauacccccagcccaccggaaguugagagagcagugcuggacgaugggaucuacaggauccuucaacguggauuacugggucgcucucaggugggcgucgggguguuccaggacggaguuuuucauacgauguggcacguaacacggggcgccgugcucauguaucaggguaagagauuggaaccuuccugggcgucagucaaaaaggaccugauuaguuacgggggaggcuggagguuccaaggcagcuggaauacuggggaggaggugcagguuauagcuguggaacccagaaagaacccaaagaauguccagaccacacccggaaccuuuaaaacuccugagggugaagugggcgccaucgcacucgauuucaagccagggaccuccggaucucccauuguaaaccgggagggcaagaucgucggucuguacgggaauggagugguuacaacgucgggcacuuaugugagcgccauugcucaagccaaagcaucacaggaaggcccucuuccggagaucgaggacgaagucuuuaagaaacgcaaccugaccauaauggauuugcacccaggguccggaaagacaagaagguaccuacccgcuaucgugcgggaggccauuaaacgaaagcugagaacccucaucuuagcgccuacucgcguuguggccagugaaauggcagaggcucugaaggguaugccaauuagguaucagacaaccgccgucaaaucugaacauacgggccgugagaucguggaccuuaugugccacgcuacuuucacaaugcggcugcucagccccguaagagugccuaauuacaacaugauaauuauggaugaggcacauuuuaccgacccggccuccaucgccgcuaggggguauaucucaacccgcguuggaaugggcgaagcggcagccauuuucaugacugcuacacccccagguucugucgaggccuuuccucagagcaaugcagugauccaagaugaagaacgagacauacccgaaagaaguuggaacuccggguacgauuggauuaccgacuucccaggaaagacagugugguuugucccuagcaucaaaucuggcaaugauauugccaacuguuugcggaagaacggcaaaaggguaauccagcugucacgcaagacuuucgacacggaguaucagaagaccaaaaauaacgacugggauuacgugguuacaacugacauauccgagaugggggcuaauuuccgugcggauagagugauugacccccggaggugccucaagccagucauccugaaagauggaccggaacgcgugauccuugccgguccuaugcccguuaccguggcaagugcugcccagcgaagaggccggauugggaggaaccaaaauaaggagggagaccaguacgucuauaugggccagccacuaaacaaugaugaagaccacgcacauuggacagaggccaaaaugcuguuggauaacaucaauacccccgaggguauuauaccugcuuuauuugaaccagagcgcgaaaagagcgccgcgaucgacggggaguacagacugaggggcgaagcacggaagacuuucguggagcucaugcgucgcggagaucugcccguauggcuuucguauaaaguggccucugagggcuuucaguacuccgaccgaagauggugcuucgauggggaaaggaacaaucaaguucuggaggaaaacauggacgucgagauuuggacgaaggaaggagagcggaaaaagcuccgcccuagaugguuggacgcuaggaccuauagcgauccgcuggcccuacgggaguuuaaagaguucgcugcaggucgaagaucagugaguggcgaccugauccucgagaucgggaaacuuccacagcaccugacauuacgcgcccagaaugcuuuggauaaccuggugaugcuccacaauucugaacagggaggcaaagccuacaggcaugcaauggaggaacugcccgacacuauugagacccuuaugcugcucgcguugauagccguccugacaggugggguuaccuuauuuuuccuauccggcaagggacugggcaagacuagcaucgggcuccuuugugugacagcuucaagugcccuguuguggauggcaagcguagagccucacuggauugcugccuccaucauucuggaauuuuuccucauggugcugcuuauccccgagccagaucggcaacguacgccucaggacaaccagcucgcauaugucgugauaggacuguuguuuaugauccugaccguugccgcuaacgaaauggguuuacuagagacuaccaaaaaggaucugggcauugggcauguggcggccgagaaucaccaacacgcaaccaugcucgacgucgaucuuagacccgcuucugccuggacccuguacgccguagcaacaacugugaucacgccaaugaugaggcauaccauugaaaacacaacugcuaauaucagcuugaccgccauagcgaaccaggcugccauucugaugggacucgacaaaggcuggccuaucuccaagauggauauugguguuccgcugcuugcauuagggugcuacucacaggugaauccccugacacucaccgccgcugucuugaugcugguggcacacuaugccaucauaggcccaggacuacaggcgaaagcuacucgcgaggcccaaaagcggacggcagccggcaucaugaagaacccuacagucgacgggauuguggcuaucgaucuggaccccguuguguacgacaccaaauucgaaaagcagcucggacagauuaugcuucugaucuuguguacuucucagauacugcucaugcgaaccacaugggcccugugcgagaguauuacuuuagcaaccggcccacuuacaacgcugugggaagguucgccugggaaauuuuggaauaccacuaucgcuguaagcauggccaacaucuucagaggauccuaucucgcgggcgccggucuagcauucucucugaugaagucagugggcgggggaaggcgcggcaugggggcucaaggagagacauugggcgagaaauggaagcggcagcugaaucagcucagcaaguccgaauuuaacaccuacaaaagaagugguauuauggaggucgaucguucugaagccaaggaggggcuuaaaaggggagaaacuacaaagcaugcaguuagccggggcaccgcuaaacugcgcugguucguggagcgaaauuuggucaagcccgaggguaaggugaucgaccugggcugugggagaggaggcuggucauauuacugcgccgggcucaaaaagguaacggaagugaaaggauauaccaagggcgguccggggcacgaggaaccaauaccuauggccacauacggauggaacuuaguuaaacugcauuccggcaaggauguguuuuucaugcccccagagaaaugugacacucuucugugcgauauuggcgaaaguagccccaauccuaccaucgaggaggggaggacacuacggguccucaagaugguggaaccguggcugcgcggaaaccaguuuuguauuaagaucuugaaucccuacaugccaucugucguggagacucuggaacaaaugcagagaaaacacgguggcaugcucguuaggaacccucuuucccgaaauucaacccacgagauguauuggguaagcugcgggacaggaaacauagugucggcggucaacaugaccucucggaugcuguuaaaucguuucacuauggcucauagaaagcccacguacgagcgcgacguggaucugggcgcagguacaaggcacguugccguggaaccugaggucgcuaacuuggacaucauugggcagcggaucgaaaauauuaaaaacgagcauaagaguaccuggcacuaugaugaagacaauccauacaaaacuugggccuaucacggauccuacgaggugaagcccagcggcucagcauccucuaugguaaacggcgugguuagacuccugaccaagccuugggaugucaucccaauggugacacaaauugccaugacggacaccacucccuuugggcagcagcgcguguucaaagagaaggucgacacaaggaccccgcgagcuaaacggggaacuacacagaucauggaaguuaccgcgaaguggcuaugggguuuucuuagcagaaauaaaaagccuaggauauguacacgcgaggaguucacucguaaggugcggaguaacgccgcaauuggcgcuguauuuguggaugagaaucaauggaacuccgccaaagaagcagucgaggacgagagauucugggaucuggugcauagggaacgcgagcuccacaagcaggggaaaugcgcuaccugcguuuauaauaugaugggaaagcgagagaaaaagcugggcgaguuugguaaggccaaagggagccgggccaucugguacaugugguugggagcgagauuccuggaguucgaggcacucggcuuuaugaacgaggaccauugguucucuagggaaaauucacuuaguggcguggagggggaaggacugcacaaguuagguuacauccugcgcgauauuuccaaaauaccaggcgggaacauguaugccgacgauacggcuggaugggacaccagaaucacagaggaugacuugcagaaugaggccaagauuacugauaucauggaacccgagcaugcacuccuggcuaccagcauuuuuaaacuaacauaccagaacaaggucgugcggguacaaaggccugccaaaaacggcacuguuauggacgugaucucucgucgagaucagcgcgguucggggcaggucggaaccuauggccuucacacguucacaaauauggaagugcagcugauaagacaaauggagucagaaggcaucuuucucccaagcgagcuggagacccccaacuuggcugaacggguguuagacuggcuggagaagcacggggccgaaaggcucaagcgcauggcaauuuccggagacgauugugucguuaaaccgaucgacgauagauucgcgacugcccuuacagcucugaaugacauggguaaggugcggaaagauauuccucagugggagcccaguaagggcuggaacgacuggcagcagguaccauuuugcucucaucacuuccaucaacuaaucaugaaagaugggagggaaauaguggucccuugucgaaaucaggacgagcuggugggacgugccagaguuagccagggcgcagguuggucccuccgcgagaccgcuugcuuggggaagucauacgcccaaauguggcagcugauguauuuucaccggagggaucuuagacuggcagccaacgcgauuuguagugcugugcccgucgacugggugccaacuucucgcaccacauggagcauccacgcccaucaccaguggaugacgaccgaagauaugcucuccguauggaaucggguuuggaucgaggaaaaccccuggauggaggacaagacucaugugucaagcugggaagaggucccuuacuuaggaaaaagggaggaccaguggugcggcucucugauuggcuugacagcacgagccaccugggcuacuaauauacaaguggccaucaaccagguuagacggcugauugggaaugaaaacuaucucgauuacaugacauccaugaagagguucaaaaaugagagugacccagaaggagcacuuugguga

SEQ ID NO: 13227 - RNA, 9879 nt, Artificial Sequence
  derived and/or modified CDS sequence (opt3) from DENV-1__FJ850070__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgccaaugggauccucgcacagggaaagaaaaugauucggccucaacccauggagcauaaguauuccuggaagucuuggggcaaagcuaagaucauaggggccgauauccagaacacuaccuuuauuaucgacggaccagauacaccugaaugucccgacgaucagcgcgcguggaauauuugggagguggaggacuacggcuucgguaucuuuacuaccaacauauggcugaaacuaagagauucgcacacacagaugugcgaccacaggcugaugagcgccgcuauuaaggauuccaaagcaguccaugccgacaugggguauuggaucgaaucagagaagaaugaaacguggaagcucgcucgugccaguuucauugaggugaaaaccuguaucuggccaaagucucacacucuguggagcaacggaguucuugaauccgagaugauaauccccaaaauuuacggcgguccuaucucacaacauaauuaucggccaggcuacuucacacagaccgcagggccguggcacuugggaaagcuggaguuagauuuugaccucugcgaaggcacuacagugguagucgaugagcacugcggguaccgaggacccagccugagaaccacgacugugaccggcaaaauuauccaugaaugguguugcaggucuuguacacuuccuccacugcgcuuccggggugaggacgggugcugguauggaauggagauaagacccgugaaggaaaaggaggaaaacuuggucagguccaugguuagugcgggcagcggugagguggacucuuuuucccucggcauucuguguguaucaauccuaaucgaagaggugaugcgcagucgauggagccggaaaaugcugaugaccgggacucucgccgucuuccugcuuuugauuaugggacagcugacauggaaugauuuaauccgucucugcauuauggugggcgcuaacgccucggacagaauggggaugggaaccacauaccuggcacuuauggcuacuuuuaagaugaggccuauguucgccguuggccugcuauuucgccggcucaccuccagagaggugcuguugcugacgauagguuuaucucucgucgcaagcguggaacugccaaauucacuugaggaacugggggauggauuggccaugggcaucaugaugcucaaacugcuaacagacuuccaaccccaccagcuguggaccacucuucucagucugaccuuuauuaggacauccuugucucuggauuaugcuuggaagacuauggcgauggccuuaagcaucguuucccucuucccgcugugucuuucaaccacgagccagaaaacaaccuggcugccuguguugcucggcaguuuugggugcaagccacugacuauguuccuaauuacagagaacaagaucuggggacgaaaaucuuggcccauaaacgaagguaucauggcagucggcauuguauccauccugcuuagcucgcuccugaagaaugacgugccuuuggcugggcccuuaauugccggaggcaugcugaucgccuguuacguuauaucagguucuagugcugaucucucccuggagaaagcagccgaggugagcugggaagaggaagcggagcauucugggaccagccacaacauucuugucgaagugcaggacgauggaacuaugaagaucaaagacgaggagcgcgaugacacacugaccaucuugcuaaaggcuacgcugcucgccgcauccggcguauauccaaugucaauuccugccacucuguuugugugguacuucuggcaaaaaaagaagcagcggaguggcguccuuugggauacccccagcccaccggaaguugagagagcuguguuagacgacgggauauauaggauccugcagcguggacucuugggucgcucucaggugggcgucgggguguuccaagauggaguuuuucauacaauguggcacguaacccggggcgcagugcugauguaccaggguaaaagacucgaaccuuccugggccucagucaagaaagaccugauuaguuacgggggaggcuggagguuccagggcagcuggaauacaggggaggaggugcagguuaucgcgguggaacccggaaagaacccaaaaaauguccaaacuacccccgguacguuuaagacaccugagggcgaagugggggcuauugcccuugauuucaagccaggaacuuccggcucucccaucguaaaccgagaggguaaaauagucgggcuguauggaaauggcgugguuaccacaucgggcaccuacgugagcgcaaucgcccaggcuaaggccucacaggaagggccuuugccggagauugaggacgaagucuuuaaaaagcggaaccuaacuaucauggaucugcacccaggauccgguaaaacccgcagauaucuccccgcaauugugagggaggcuaucaagcggaaguuacgaacacugauacuugccccuacgagaguuguggcgagugaaauggccgaggcacugaaaggcaugccaauucgcuaccaaacuaccgcugucaagucugaacauacagggagggagaucguggaccucaugugccacgccaccuucacuaugcguuugcugagccccguacgggugccuaauuauaacaugaucauuauggaugaggcucauuuuacagacccggcauccaucgccgccagaggauacauaucaaccaggguuggcaugggugaagcugcggcaauuuucaugacggccacucccccagggucugucgaggcuuuuccucagagcaaugccgugauccaggaugaagagcgcgacauucccgaacgaaguuggaacuccggauaugauuggaucacagacuucccaggcaaaaccgugugguuugucccuagcauaaagucuggcaaugacauugcaaacugucucagaaaaaaugggaagcggguaauccagcugucaaggaagaccuucgauacugaguaccaaaaaacaaagaacaacgacugggauuacgugguuaccacagacaucuccgagaugggagccaauuuccgcgcugaucgugugauugaccccagacggugccuuaaaccagucauccuaaaggaugguccggaaagggugauucuggcgggcccuaugcccguuacuguggccagugcagcucagcgccgagggagaauaggacggaaccagaauaaagagggcgaccaguauaucuacaugggucaaccauugaacaaugaugaagaccacgcccauuggacggaggcaaagauguuacuggauaacauuaauacccccgaggggaucaucccugcccucuuugaaccagagagggaaaagagcgcugccauugacggcgaguaucgccugagaggagaagcgaggaaaacauucgucgagcuuaugcggcguggcgaucugcccguguggcucucguacaagguagcaucugagggguuucaguauuccgaccgccgauggugcuucgacggagaaagaaacaaucagguguuggaggaaaacauggauguugagauauggacuaaagaaggugagaggaagaaacugcggccucgcuggcuagacgccagaaccuacagcgauccgcuggcucucagggaguuuaaggaauucgccgcuggccggcgaucagucaguggggaccuuauccuggagauuggaaaauuaccacagcacuugacacugagagcacaaaaugcccucgauaaccuggugaugcuucacaauucugaacagggcgguaaggcuuaucgccaugccauggaggaacugcccgacaccaucgagacucucauguugcuggcauuaauugcggugcuaacggggggcgucacccuguuuuuccucuccggaaagggccuugggaaaacaagcaucggacuguuguguguuauggccucaagugcucugcucuggauggccagcguggagccucacuggauagcagcuuccaucauucuggaauuuuuccuuaugguacuccugauccccgagccagauaggcagcggacuccucaggacaaccaauuggccuacguggucauuggucuguuauuuaugauccuaaccguggcagccaaugaaaugggccugcucgagacaaccaagaaagaucuugggauaggacauguugcugcggagaaccaccaccaugccacuaugcuggacguggauuugcaccccgcaucugcuuggacacuguacgccgucgccacgaccguaauuacuccaaugaugcgucauacaaucgaaaacaccaccgcaaauauuagccucacagcuaucgccaaccaggcggcuauacugaugggccuugacaaggguuggccuaucuccaaaauggauauuggggugccguuacuggcccucggcugcuauucacagguuaaucccuugacucugacggcagccgugcuaaugcuggucgcucacuacgcaaucauuggaccaggccuccaagccaaggcgaccagagaggcucagaagaggacagccgcagggaucaugaaaaacccuacuguggacggaauagucaccauugaccuugaucccgugguuuaugacgccaaguucgaaaaacagcugggccagaucauguugcugauccucuguacaucucaaauucuguuaaugcgcaccacuugggcucuuugcgagaguaucacgcuggccacagguccacucaccacucuaugggaagggucgccuggaaaguuuuggaauaccacaauagcagugagcauggcuaacauuuuccggggcuccuaccuggccggugcgggcuuggccuucucucugaugaaaucacucgggggaggccgaagagggacuggagcacagggcgagacccuuggugagaaguggaagaggcagcugaaucaguugagcaaauccgaauuuaacacauauaagaaaagugggaucauggagguagaucgcucugaagcuaaggagggacugaaacggggcgaaacgaccaagcaugccgugagcagagguacugcaaagcuccguugguucgucgagaggaauuuaguuaaacccgagggcaaggugauugaccugggguguggacggggcggguggucauacuauugcgcuggacuuaaaaaggucacagaagugaaaggcuacaccaagggugggccgggacacgaggaaccaaucccuauggccacuuacggcuggaaccugguaaaacuacacuccggcaaggauguguuuuucacacccccagagaagugugacacccuccugugcgauauaggggaaaguagccccaauccuacgaucgaggagggacgcaccuugcgaguucugaaaaugguggaaccguggcucagagguaaccaauuuuguauuaagauccuuaaucccuauaugccaucugucguggagacacuggaacagaugcagaggaaacauggcgggauguuaguccggaacccucugucccgcaauucaacucacgagauguacugggugagcugcggaaccggcaacauuguuucggccguaaauaugacaucuagaauguugcucaacagguucacuauggcgcaucgaaagcccaccuaugagcgggacguggaucugggugcugggacacgucacgucgcaguggaaccugagguugccaaccuagacaucauuggacagagaaucgaaaauauaaaaaacgagcacaagaguaccuggcauuacgaugaagacaauccauauaagacuugggcuuaccacggcuccuaugaggugaaaagcucaggcuccgccucuagcauggucaacggggugguacgccuucugacgaagcccugggacgugauuccuaugguuacacaaaucgcaaugaccgauacuaccccauuuggacagcagagggucuucaaagagaagguggacacacggacgcccagagccaaacgcgguaccgcucaaaucauggaagugacugcgaaguggcucuggggcuuucugaguaggaauaagaaaccgcgaauuuguacacgggaggaauucaccagaaaggucagguccaacgccgcaauaggggcuguuuuuguggaugagaaucaguggaacagcgccaaagaagcaguagaggacgagcgcuucugggauuuggugcaucgugaacgggagcugcacaagcagggaaaaugcgccacuugcgucuacaauaugaugggcaagagagaaaagaaacucggugaguuugggaaggcuaaaggaucuagggccaucugguacauguggcuuggcgcgcgcuuccuggaauucgaggcauuaggcuuuaugaacgaggaccauugguucucacgagaaaauagucuguccgggguggagggagaagguuugcacaagcucggcuauauucugcgggauaucagcaaaauuccugggggaaacauguacgccgacgauacagcuggcugggacaccagaaucacagaggaugaccuacagaaugaggccaagauaacugauaucauggaaccagagcacgcacuucuggcuaccucuauuuuuaaacucacguaucaaaacaagguugugaggguccagcgccccgccaagucggguaccgugauggacguaaucucaagacgggaccagagggggagcggacagguuggcacauacggccugaauacuuucaccaacauggaagugcaauugauucgucagauggaguccgaagggaucuuuaguccuucugaguuagagacaccaaaccuggcuaaacgaguccucgauuggcuugaaaagcauggagccgagcgccugaaaagaauggcaauaagcggugacgauuguguggugaagcccauugacgaucgguucgcgacugcccuaaccgcucugaaugacaugggcaaagucaggaaggauaucccgcagugggaaccuuccaagggguggaacgacuggcagcaaguucccuuuugcucacaccauuuccaccagcucaucaugaaagauggacgcgagauugugguaccauguagaaaucaggacgaauuggugggccgggccagggucagucagggugcaggguggucucugcgagagacggcuugccuuggaaagagcuaugcccaaauguggcagcugauguacuuucaccguagagaucuccgcuuagcagccaacgcgauauguuccgcugugccuguugacugggugcccacaucacggaccacuuggagcauccaugcccaccaucaguggaugacaaccgaggacaugcugucugucuggaauaggguguggauugaagagaacccauggauggaagauaaaacucacguauccaguugggaggaaguucccuauuugggcaagagagaggaccaauggugcggcagccugaucgggcucaccgcacgcgccacaugggcuacgaauauucagguggccaucaaccagguccggaggcuuauaggaaaugagaacuaccuggauuacaugaccucgaugaaacgauucaagaaugaauccgacccugagggugcacuaugguga

SEQ ID NO: 13228 - RNA, 9879 nt, Artificial Sequence
  derived and/or modified CDS sequence (opt3) from DENV-1__FJ850071__SS-prME
agcgugacaaugcugcucaugcuucugcccacggccuuggcuuuccacuuaacuacgagaggcggggaaccucauaugaucgucuccaagcaggaaagaggaaaaucucugcuguuuaagaccucaguuggugugaacaugugcacacucauugccauggaccugggcgaacuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggcaccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuggauaucgaacuccugaaaacagaggugaccaacccugcaguccuuagaaagcugugcauugaagccaaaaucuccaauacgaccacagacucuagguguccaacucaaggagaggcuaccuugguugaagaacaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaaaagcuggcugguacauaaacagugguuucuugaccugccguugcccuggacgucuggcgccuccaccucacaagaaacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggaucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacuaaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgccaaugggauccucgcacagggaaagaaaaugauucggccucaacccauggagcauaaguauuccuggaagucuuggggcaaagcuaagaucauaggggccgauauccagaacacuaccuuuauuaucgacggaccagauacaccugaaugucccgacgaucagcgcgcguggaauauuugggagguggaggacuacggcuucgguaucuuuacuaccaacauauggcugaaacuaagagauucgcacacacagaugugcgaccacaggcugaugagcgccgcuauuaaggauuccaaagcaguccaugccgacaugggguauuggaucgaaucagagaagaaugaaacguggaagcucgcucgugccaguuucauugaggugaaaaccuguaucuggccaaagucucacacucuguggagcaacggaguucuugaauccgagaugauaauccccaaaauuuacggcgguccuaucucacaacauaauuaucggccaggcuacuucacacagaccgcagggccguggcacuugggaaagcuggaguuagauuuugaccucugcgaaggcacuacagugguagucgaugagcacugcggguaccgaggacccagccugagaaccacgacugugaccggcaaaauuauccaugaaugguguugcaggucuuguacacuuccuccacugcgcuuccggggugaggacgggugcugguauggaauggagauaagacccgugaaggaaaaggaggaaaacuuggucagguccaugguuagugcgggcagcggugagguggacucuuuuucccucggcauucuguguguaucaauccuaaucgaagaggugaugcgcagucgauggagccggaaaaugcugaugaccgggacucucgccgucuucuuucugcuuauuaugggacaguugacauggaaugaucugauccguuuaugcauuauggugggcgcuaacgccucggacagaauggggaugggaaccacauaccucgcacugauggcuacuuucaagaugaggccuauguuugccguuggccuucuguuccgcaaacuaaccucccgggaggugcuccuguugacgauaggucugucuuuagucgcaagcguggaacucccaaauucacuggaggaacuuggggauggacuggccaugggcaucaugauguugaagcuccugacagacuuucaaccccaccagcuauggaccacucugcuuagucucaccuucauuagaacaucccugucuuuggauuaugcuuggaaaacuauggcgauggcccugagcaucguuuccuuauuuccgcucugucugucaaccacgagccagaagacaaccuggcuuccugugcuguugggcaguuucgggugcaagccacucacuauguuucugauuacagagaacaaaaucuggggaaggaagucuuggcccauaaacgaagguaucauggcagucggcauuguauccauccuacugagcucgcuucucaaaaaugacgugccucuggcugggcccuugauugccggaggcauguuaaucgccuguuacguuauaucagguucuagugcugaucugucccucgagaaggcagccgaggugagcugggaagaggaagcggagcauucugggaccagccacaacauucuggucgaagugcaggacgauggaacuaugaaaaucaaggacgaggagcgagaugacacacuuaccauccuguugaaagcuacgcuacuggccguauccggcguguauccaaugucaauuccugcaacucucuucgucugguacuucuggcaaaagaagaaacagcgcaguggcguucugugggauacccccagcccaccggaaguggagcgggccgugcuugacgacgggauauauagaaucuuacagaggggacugcucggucguucucaggucggcguggggguuuuucaagauggaguauuccauacaauguggcacgugacccgcggcgcugucuugauguaccaggguaagcggcuggaaccuuccugggcaucagugaaaaaggaccucauuaguuacgggggaggcuggagauuucagggcagcuggaauacaggggaggagguucaggugaucgccgucgaacccggcaaaaacccaaagaaugugcaaacuacccccgguacguucaagacaccugagggcgaaguaggggcgauugcucuggauuuuaaaccaggaacuuccggcucucccaucgucaacagggaggguaagauaguggggcuuuauggaaauggcguugugaccacaucgggcaccuacgucagcgccaucgcacaggccaaggcuucacaggaagggccucugccggagauugaggacgaaguguucaagaaacgaaacuugacuaucauggaucuacacccaggauccgguaagacccggcgcuaucugcccgccauuguuagagaggcaaucaagaggaaacuccggacauuaauacuggcuccuacgcgaguggucgccagugaaauggcggaggcccuuaagggcaugccaauuagauaccaaacuaccgcagugaaaucugaacauacagggcgcgagaucguagaccugaugugccacgcuaccuuuacuaugaggcucuugagccccgugcguguuccuaauuauaacaugaucauuauggaugaggcccauuucacagacccggcuuccaucgcagcccggggauacauaucaaccagagucggcaugggugaagccgcugcgauuuuuaugacggcaacucccccagggucuguggaggccuucccucagagcaaugcugugauccaggaugaagagagggacauucccgaacgcaguuggaacuccggauaugauuggaucacagacuuuccaggcaagaccgucugguucguaccuagcauaaaaucuggcaaugacauugccaacugucugcgaaagaaugggaagagagugauccagcucucacggaaaaccuucgauacugaguaccaaaagaccaaaaacaacgacugggauuacguugugaccacagacaucuccgagaugggagcaaauuuuagggccgaucgcgucauugacccccguagaugccugaagccagugauccuuaaagaugguccggaacggguuauucuagcuggcccuaugcccgugacugucgcgagugccgcacagaggcgcgggcgaauaggaagaaaccagaauaaggagggcgaccaguauaucuacaugggucaaccacugaacaaugaugaagaccacgcucauuggacggaggccaagauguuguuagauaacauuaauacccccgaggggaucaucccugcacuguucgaaccagagcgggagaaaagcgccgcuauugacggcgaguauaggcuccgcggagaagccagaaagacauuuguggagcugaugaggcggggcgaucuucccguauggcugucguacaaaguggcgucugagggguuccaguauuccgaccgucgcuggugcuuugacggagaacgaaacaaucagguucucgaggaaaacauggaugucgagauauggacuaaggaaggugagaggaaaaaguugaggccucgguggcuggacgcacgcaccuacagcgauccgcuagcccugagagaguucaaagaauuugcugccggcaggcggucagugaguggggaccucauccuugagauuggaaagcugccacagcacuuaacauugcgagcucaaaaugcacuggauaaccucgugaugcugcacaauucugaacagggcgguaaggccuauagacaugcuauggaggaacuucccgacaccaucgagacucugaugcucuuggcccugauugcagucuuaacagggggcguuacccuauucuuucuguccggaaaaggccucgggaagacaagcaucggacuucugugugugauggcgucaagugccuugcuguggauggcuagcguagagccucacuggauagccgcauccaucauucucgaguucuuucugauggugcuucucauccccgagccagaucgccagaggacuccucaggacaaccaacuggcuuacgucgugauugguuugcuguucaugaucuuaaccguugccgcaaaugaaaugggccuacuggagacaaccaaaaaggaucucgggauaggacauguggccgcugagaaccaccaccaugcgacuaugcuugacgucgaucugcggcccgccucugcauggacauuguacgcuguagccacgaccgugauuacuccaaugaugcgucacacaaucgaaaacaccaccgccaauauuagccugacagcaaucgcuaaccaggccgcgauacucaugggccuggacaaagguuggccuaucuccaagauggauauugggguuccgcuuuuagcucugggcugcuauucacaggugaauccccucacuuugacggccgcaguccugaugcuaguggcccauuacgcuaucauuggaccaggccugcaagcaaaggccaccagagaggcgcagaaaaggacagcugccgggaucaugaagaacccuacugucgacggaauagugaccauugaccucgaucccguuguguaugacgcaaaauuugaaaagcagcuuggccagaucaugcuguugauccuguguacaucucaaauucuccugaugcgcaccacuugggccuuaugcgagaguaucacgcuugcuacagguccacugaccacucucugggaagggucgccuggaaaauucuggaauaccacaauagccguaagcauggcaaacauuuuccggggcuccuaccuagcuggugccggccuggcguuuucuuugaugaagucacuagggggaggccgaagagggacuggagcccagggcgagacccucggugagaaguggaaaaggcagcuuaaucagcugagcaaguccgaguucaacacauauaaaaagagugggaucauggagguggaucgcucugaagcaaaagagggauugaagcggggcgaaacgaccaagcacgcugucagcagagguacugccaaacugcguugguuuguugagaggaaucucgugaagcccgagggcaaagucauugacuuaggguguggacggggcggguggucauacuauugcgcaggacugaagaaagugacagaaguaaagggcuacaccaaaggugggccgggacaugaggaaccaaucccuauggcuacuuacggcuggaaccuugugaagcugcacuccggcaaggauguuuucuuuacacccccagagaaaugugacacccuacucugcgauauaggggaaaguagccccaauccuacgaucgaggagggacgcacccugcgaguguugaagauggucgaaccguggcugagagguaaccaauucuguauuaaaauccucaaucccuauaugccaucuguggucgagacacuugaacagaugcagaggaagcacggcgggaugcuggugcggaacccuuuaucccgcaauucaacucaugagauguacuggguuagcugcggaaccggcaacauuguaucggccgugaauaugacaucuagaaugcuguugaacagguuuacuauggcccaccgaaaacccaccuaugagcgggacgucgaucucggugcggggacacgucauguggcuguugaaccugagguggcaaaccuggacaucauuggacagagaaucgaaaauauaaagaacgagcacaagaguaccuggcacuacgaugaagacaauccauauaaaacuugggccuaccauggcuccuaugaggucaagcccagcggcucagcuuccucuauggugaacgggguagugcgccuacuuacgaaaccuugggacguuauuccaauggucacacaaaucgccaugaccgauacuacccccuucggacagcagaggguguuuaaggagaaaguggacacacggacgccgagagcaaagcgcgguaccgcccaaaucauggaagucacugcuaaguggcuguggggcuuccucagcaggaauaaaaagccucgaauuuguacacgggaggaauuuaccagaaaaguuaggaguaacgcggccauaggggcaguguucguagaugagaaucaguggaacuccgcuaaggaagccguggaggacgagcgcuuuugggaucugguccaccgugaacgggaguugcauaaacagggaaagugcgcaacuugcguguacaauaugaugggcaagagagagaaaaagcugggugaguucgggaaagccaagggaagcagggcuaucugguacauguggcucggcgcccgcuuccuugaauuugaggcgcugggcuucaugaacgaggaccacugguuuucucgagaaaauucauuaagugggguugagggagaaggucugcauaaauugggcuauauucuccgggauaucuccaagauuccagggggaaacauguacgcagacgauacagccggcugggacaccagaaucacagaggaugaccugcagaaugaggcuaaaauaacugauaucauggaacccgagcacgcccuacuugcaaccagcauuuucaagcugacguaucaaaacaagguggucagggugcagcgcccugcuaaaucugguaccguaauggacguuaucucgagacgggaccagagggggucaggacaggugggcacauacggccucaauacuuuuaccaacauggaaguccaacugauucgucagauggagagcgaagggaucuucuccccaagugaguuggagacacccaacuuagccaagcgagugcuggauuggcucgaaaaacacggagcugagcgccuuaagagaauggccauaucuggugacgauuguguggucaaaccgauugacgaucgguuugcaacugcgcugaccgcccuaaaugacaugggcaagguuaggaaggauaucccucagugggaacccagcaaaggguggaacgacuggcagcaagugccauucugcucccaucacuuucaucagcugaucaugaaggauggacgcgagauuguagugccuuguagaaaucaggacgaacucgucggccgggcuagggugucacagggugccggguggaguuugcgagagacggcaugccugggaaaaucuuaugcucaaauguggcagcuuauguacuuccaccguagagaucugcgccucgccgcaaacgccauauguagcgcgguucccguggacugggucccaacaucccggaccacuuggucaauccacgcucaucaccaguggaugacaaccgaggacauguuaagcguguggaauaggguauggauugaagagaaccccuggauggaagauaagacucauguuucuuccugggaggaagugccuuaucugggcaaaagagaggaccaauggugcggcaguuugaucgggcugaccgcccgcgcaacaugggccacgaauauucaggucgcuaucaaccaggugcggaggcucauaggaaaugagaacuaccuugauuacaugaccagcaugaagcgauuuaagaaugaaucggacccagagggugcccugugguga

SEQ ID NO: 13229 - RNA, 9879 nt, Artificial Sequence
  derived and/or modified CDS sequence (opt3) from DENV-1__FJ850073__SS-prME
agcgugaccaugcugcucaugcuucugcccacugcauuggcuuuccacuuaacuacgagaggaggggagccucauaugaucgucuccaagcaagaaaggggaaaaucucugcuauuuaagaccucagccgguguuaacaugugcacucucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggacgagcuugggaggagggcgucugcgguaucaggagcgccacccggcucgaaaauauuauguggaaacagauauccaacgagcugaaucauaucuuacuggaaaacgacauuaaguucacugugguugugggcaaugcagacgggauccuugcucagggcaaaaagaugauucgcccucaacccauggagcacaaauacucuuggaagucguggggcaaggccaaaaucauaggggcggauauccagaacaccacauuuauuaucgacggaccagauacuuuggaauguccugacgagcagagagccuggaauauuugggaggucgaagauuauggcuucgguaucuuuaccacaaacauauggcucaagcugagggacagcuacacgcagaugugcgaucaccgucuaauguccgcugcaauuaaagacucaaaggccgugcaugcugauaugggguauuggaucgagagugagaaaaaugagaccuggaagcuggcccgggcaucuuucauugaaguuaagacuuguaucuggcccaaaagccacacacucugguccaacggagugcuggagucagagaugauaaucccaaagauguacggcggucccguaagccaacauaauuaucgaccuggcuacuucacccagacugcggggccauggcaccuuggaaaauuggaacuggacuuugauuuaugcgagggcacaaccgucgugguggacgaacacugcgggucuagaggaccgucccucaggacgacuaccgucacaggcaagauuauccaugagugguguugccgcaguuguacccugcccccucuucgguucagaggugaggaugggugcugguacggaauggaaauuaggccaguuaaagagaaggaagagaaccuggugcgcagcaugguaucugccggcuccggugaaguggacucauuuaguuugggcguccucugugugagcaucaugauagaggagguuaugcgaucgcgguggucccguaagaugcugaugacugggacacuagcuguguuccugcuccugauuaugggacagcuuaccuggaaugacuugaucagacugugcaucauggucggcgccaacgcaucugauaaaauggggaugggaacaacuuauuuagcucucauggccaccuuuaagaugaggcccauguucgcagugggccugcuuuuucgccggcugacgagcagagaaguucuacuccugacaauugguuugucacugguggccagugucgaguuaccuaauucccucgaggaacugggggacggacuugcuaugggcaucaugaugcugaaauugcucaccgaguuccaaccacaccagcuguggacuacccuacugucucuuacauuuauuaagacuacccucagccuggauuacgcguggaaaacgacagccaugguauuguccauagugucacuguuccccuuaugucucagcaccacaagucagaagacaaccuggcugccgguucuucugggcucuuuugggugcaagccuuugacuauguuccucaucacagagaacgagauuuggggaaggaaauccuggccacugaacgaagguaucauggcaauuggcaucgugagcauacuacugucgucacuucucaagaaugacgucccccuggcugggccuuugaucgccggaggcauguuaauugccuguuaugugaucucugguaguuccgcugaucugagccucgagaaagcagccgaaguaucuugggaggaagagguggagcauagcgggaccucccacaacauucuggucgaaguucaggacgauggaacgaugaagaucaaagacgaggaacgagaugacacucuuaccauacuguugaaggcgacacuacuggcugugucaggcguguaccccaugaguauuccagccacccucuuugucugguauuucuggcagaaaaagaagcagcgcagcggcgugcugugggauacaccuucucccccagagguugagcgggcaguacuugacgaugggaucuacagaaucuuacagaggggacugcucggucguucccaggugggcgucgggguguuccaagacggaguuuuucauacuauguggcacgugacccgcggcgccgucuugauguaucaggguaaacggcuggaaccgucaugggcuagugugaagaaagaccucauuagcuacgggggaggcuggagauuccagggcuccuggaauacgggggaggaaguacaggucauagcaguggagccuggaaagaaccccaaaaauguucaaacaacuccagguaccuuuaagacacccgaaggcgaggugggggccaucgcgcuggauuucaagccuggaaccucuggcucgccaauugucaacagggaggguaaaaucguggggcuuuacggaaauggcguugugacuaccagcggcacauaugucucagcuauugcccaggcaaaggccucccaggaagggccccugccugagaucgaagacgagguguuuaaaaagcgaaacuugacgauaauggaucuacacccgggaagugguaaaacucggcgcuaccugccagcuaucguaagagaagccauuaagaggaagcuccggaccuuaauccuggcacccacacgagugguugcuucugagauggccgaggcgcuuaaaggcaugccuauuagauaucaaaccacugccgucaagagcgaacauacagggcgcgagaucguggaccugaugugccacgcaaccuucacgaugaggcucuuguccccagugcguguccccaauuacaacaugauaauuauggaugaagcucauuuuacugacccugccucaaucgcugcacggggauauaucucuacaagaguaggcaugggugaggccgccgcuauuuucaugaccgcgaccccgcccgggagcguggaagcauuuccacagaguaaugccguuauccaggaugaggagagggacauaccugaacgcuccuggaacagcggauacgauuggauuacugacuuccccggcaaaacagugugguuugucccaucuaucaagucaggcaaugauauugcuaacugucugcggaaaaaugggaagagagugauccagcucuccagaaagaccuucgacacagaguaucagaaaacuaagaacaacgacugggauuacguugugacgaccgacauaagugaaaugggagccaauuucagggcagaucgcgucauugacccucguagaugccugaaacccgugauccuuaaggaugguccagagcggguaauccuagccggcccgaugccugugacaguugcuagcgcggcccagaggcgcgggcgaauuggaagaaaccagaauaaagagggcgaccaguacgucuauaugggucaaccccugaacaaugaugaagaccacgcacauuggacugaggcuaagauguuguuagauaacaucaauaccccagaagggauuauacccgcccuguuugagccugaacgggagaagucggcagccaucgacggcgaguacaggcuccgcggagaagcuagaaaaacauucguggagcugaugaggcggggcgaucuuccaguguggcugucuuauaaggucgccuccgaaggguuucaguacagcgaccgucgcuggugcuucgauggagagcgaaacaaucagguucucgaagagaacauggacguggagauuuggaccaaagaaggugagagaaagaaauugaggccccgguggcuggacgcgcgcacuuauucagauccucuagcacugagagaauuuaaggaguucgccgcuggcaggcggaguguaucuggggaccucauccuugaaaucggaaaacugccgcagcacuuaacguugcgagcccaaaaugcucuggauaaccucgugaugcugcacaauuccgagcagggcgguaaggcauacagacaugccauggaggaacuuccagacaccauugagacacugaugcucuuggcucugauggccgucuuaacugggggcgugacccuauuuuuccugagcggaaagggccucgggaaaacaucaauaggacuucuguguguuauggcaaguagcgcguugcuguggauggccuccguggaaccccacuggaucgcugccucuauuauccucgaguuuuuccugaugguccuucucauuccugagcccgaucgccagaggaccccacaggacaaccaacuggcauauguagugaucgguuugcuguuuaugauauuaacuguugcugccaaugaaaugggccuacuggagacaacgaagaaagaucucgggaucggacauguggcagccgaaaaccaccagcacgcuaccaugcuugacgucgaucugcauccugcgagcgccuggacuuuguacgcaguggcuacaaccgucauuacccccaugaugcggcacacaaucgagaacacuacggccaauauuucccugaccgccaucgcaaaccaggcugccauacucaugggccuggacaaggguuggccaauuucaaaaauggaucuuggggugccuuuacuggcgcucggcugcuacucucaaguuaauccguugacacugacugcugccgugcuaaugcugguagcacauuaugccaucauuggacccggccuccaggcuaaggcaacccgugaagcccagaagagaacagcggcugggaucaugaaaaacccaaccguggacggaauagucgccaucgaucuugacccuguuguguacgacgcaaaguucgagaaacagcugggccaaauuauguugcugauccucuguacgagucagauucuguuaaugaggacuacaugggcccuuugcgagucgaucacccuggcuacugguccccucaccacacuaugggaagggagcccaggaaaguuuuggaauacuaccauagccgucuccauggcaaacauuuuccgcggcucuuaucuggcuggugccggcuuggcguucucacugaugaaaagccucgggggaggccggcgagggacaggagcccagggcgagacgcuuggugaaaaguggaagagacagcugaaucaauuguccaaaagugaguuuaacaccuacaagaggucugggaucauggaaguggaucgcagcgaggcaaaagagggacugaagcggggcgaaacuacaaaacacgcuguaucaagagguaccgccaagcuccguugguucguggagaggaauuuaguuaagccugaaggcaaagugaucgaccugggguguggacggggcgggugguccuauuacugcgcaggacuuaagaaagucacugaggugaagggcuauacaaaaggugggcccggacaugaagaaccgauuccaauggcuaccuacggcuggaaccuggucaagcuacacaguggcaaagauguguuuuucaugccucccgagaagugugacacgcuccugugcgauaucggggaaagcucuccaaaucccaccauagaggaaggacgcacauugcgaguucugaagaugguagagccuuggcucagagguaaccaguuuuguauuaaaauccuuaauccguacaugcccuccguggucgagacucuggaacagaugcagaggaagcacggcgggauguuagugcggaacccacugucacgcaauagcacccaugagauguauuggguuucgugcggaacaggcaacauugugucugccgucaauaugacaaguagaauguugcucaacagguucaccauggcccaccgaaaaccuacauacgaacgggacguggaucugggugcggggacccgucauguagcuguggagcccgaaguugcaaaccuagacaucauaggacaaagaaucgagaauauuaagaacgagcacaaauccacuuggcacuaugaugaagacaauccuuacaagacgugggccuaucauggcagcuacgaggucaagccaucaggcuccgcuucuagcauggugaacggggugguccgccuucugacaaaacccugggauguuaucccuauggugacccagauugccaugacugacaccacaccauuuggacagcaaaggguauucaaggaaaaaguggacacgcggacccccagagcaaagcgcgguacugcccagaucauggaggucacagcuaaauggcucuggggcuuucugaguaggaauaagaagccgcgaauuuguacccgggaagaguucacuagaaaagugagguccaacgcggccaucggggcaguuuuuguggaugagaaucaguggaacagcgcuaaggaagccgucgaggacgaacgcuucugggauuuggugcaccgugagcgggaacugcauaaacagggaaagugcgcaacaugcguauauaauaugaugggcaaaagagagaagaagcucggugaguuugggaaagccaagggaucuagggcuauaugguacauguggcuuggcgcccgcuuccuggaguucgaggcguuaggcuuuaugaacgaagaccacugguucucacgagagaauagucuguccgggguugagggagaagguuugcauaaacucggcuacauucugcgggauaucagcaagaucccugggggaaacauguaugcagacgauaccgccggcugggacacaagaauuacugaggaugaccuaaggaaugaagcuaaaauaaccgauaucauggagccagaacacgcccuucuggcaacgucuauuuuuaagcucaccuaccaaaacaaagugguccgcgugcagagacccgcuaagaaugguacagugauggacgucaucucgcggagggaucagcgugggucaggacagguuggcacuuauggccugaacaccuucacaaacauggaggugcaauugauucgacagauggagagcgaagggaucuuuuucuccagugaguuagaaucuccuaaucuggccgagcgcguacucgacuggcuugaaaagcacggagcugagagacugaaacggauggccauaagcggugacgauuguguggucaagccaaucgacgauagguuugcaacugcgcuaauugcccugaacgacaugggcaaagugcgcaaggauaucccccagugggagccguccaaaggguggaaugacuggcagcaaguuccuuucugcucacaucacuuucaucagcucauuaugaaggauggaagagaaaucgugguccccugucggaaccaggacgaguuggugggcagggcucgaguaagucagggugccggguggucucugcgugaaaccgcaugccuuggaaagagcuacgcucaaauguggcagcugauguauuuccacagacgcgaucuccgguuagccgcaaaugccauauguuccgcgguuccaguggacugggucccuacgucaaggacaaccuggagcauucacgcucaucaccaguggaugacuacagaggauaugcugucuguguggaacagaguuuggaucgaagagaaucccuggauggaggacaaaacccauguguccaguugggaagaggucccauacuugggcaagcgcgaagaccaauggugcggcagccugaucgggcucacugcccgggcaaccugggccacaaacauucagguggcuauaaaucagguaaggcgacuuaucggaaacgguaauuaucuggauuacaugacgucgaugaaaagauuuaagaacgaguccgaccccgagggcgcccuaugguga

SEQ ID NO: 13230 - RNA, 9879 nt, Artificial Sequence
  derived and/or modified CDS sequence (opt3) from DENV-1__FJ850075__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgccaaugggauccucgcacagggaaagaaaaugauucggccucaacccauggagcauaaguauuccuggaagucuuggggcaaagcuaagaucauaggggccgauauccagaacacuaccuuuauuaucgacggaccagauacaccugaaugucccgacgaucagcgcgcguggaauauuugggagguggaggacuacggcuucgguaucuuuacuaccaacauauggcugaaacuaagagauucgcacacacagaugugcgaccacaggcugaugagcgccgcuauuaaggauuccaaagcaguccaugccgacaugggguauuggaucgaaucagagaagaaugaaacguggaagcucgcucgugccaguuucauugaggugaaaaccuguaucuggccaaagucucacacucuguggagcaacggaguucuugaauccgagaugauaauccccaaaauuuacggcgguccuaucucacaacauaauuaucggccaggcuacuucacacagaccgcagggccguggcacuugggaaagcuggaguuagauuuugaccucugcgaaggcacuacagugguagucgaugagcacugcggguaccgaggacccagccugagaaccacgacugugaccggcaaaacaauucaugaaugguguugcaggucuuguacccuuccuccacugcgcuuccggggugaggacgggugcugguauggaauggagaucagacccgugaaggaaaaggaggaaaacuuggucagguccaugguuagugcgggcagcggugagguggacucuuuuucccucggcauacuguguguaucaauucuaaucgaagaggugaugcgcagucgauggagccggaaaaugcugaugacugggacacucgccgucuuccugcuuuugaucaugggacagcugaccuggaaugauuuaauucgucucugcaucauggugggcgcuaacgccucggacagaauggggaugggaacaacuuaccuggcacuuauggcuaccuuuaagaugaggccuauguucgccguuggccugcuauuucgccggcucacguccagagaggugcuguugcugacaauugguuuaucucucgucgcaagcguggaacugccaaauucacuugaggaacugggggauggauuggccaugggcauaaugaugcucaaacugcuaaccgacuuccaaccccaccagcuguggacuacccuucucagucugacauuuaucaggacuuccuugucucuggauuaugcuuggaagaccauggcgauggccuuaagcauuguuucccucuucccgcugugucuuucaacgacaagccagaaaaccacuuggcugccuguguugcucggcaguuuugggugcaagccacugacaauguuccuaaucaccgagaacaagauuuggggacgaaaaucuuggcccaucaacgaagguauaauggcagucggcaucguauccauucugcuuagcucgcuccugaagaaugacgugccuuuggcugggcccuuaaucgccggaggcaugcugauugccuguuacguuaucucagguucuagugcugaucucucccuggagaaagcagccgaggugagcugggaagaggaagcggagcauucugggacuagccacaacauacuugucgaagugcaggacgauggaacaaugaagauuaaagacgaggagcgcgaugacacccugacgaucuugcuaaaggcuacucugcucgccguauccggcguguauccaaugucaaucccugcaacccuguuugucugguacuucuggcaaaaaaagaagcagcggaguggcguucuuugggauacacccagcccaccggaaguggagagagccguguuagacgacgggauuuauaggauacugcagcguggacucuugggucgcucucaggucggcguggggguuuuccaagauggaguauuucauaccauguggcacgugacacggggcgcuguccugauguaccaggguaaaagacucgaaccuuccugggcaucagugaagaaagaccugaucaguuacgggggaggcuggagguuccagggcagcuggaauacuggggaggagguucaggugauugccgucgaacccggaaagaacccaaaaaaugugcaaaccacgcccgguacauuuaagacuccugagggcgaaguaggggcgaucgcucuugauuucaagccaggaaccuccggcucucccauugucaaccgagaggguaaaaucguggggcuguauggaaauggcguugugacaaccucgggcacuuacgucagcgccauagcacaggccaaggcuucacaggaagggccuuugccggagaucgaggacgaaguguuuaaaaagcggaaccuaaccauuauggaucugcacccaggauccgguaaaacacgcagauaucuccccgccaucguuagggaggcaauuaagcggaaguuacgaacgcugauccuugcuccuacuagaguggucgccagugaaauggcggaggcccugaaaggcaugccaauacgcuaccaaaccacagcagugaagucugaacauaccgggagggagauuguagaccucaugugccacgcuacuuucacaaugcguuugcugagccccgugcggguuccuaauuauaacaugaucaucauggaugaggcccauuuuaccgacccggcuuccauugcagccagaggauacaucucaacgagggucggcaugggugaagccgcugcgauauucaugacugcaacacccccagggucuguggaggccuuuccucagagcaaugcugugauucaggaugaagagcgcgacauccccgaacgaaguuggaacuccggauaugauuggauuaccgacuucccaggcaaaaccgucugguuuguaccuagcaucaagucuggcaaugacauagccaacugucucagaaaaaaugggaagcgggugauucagcugucaaggaagacuuucgauacagaguaccaaaaaaccaagaacaacgacugggauuacguugugacaacugacaucuccgagaugggagcaaauuuccgcgccgaucgugucaucgaccccagacggugccuuaaaccagugauucuaaaggaugguccggaaaggguuauccuggcuggcccuaugcccgugacggucgcgagugccgcacagcgccgagggagaauuggacggaaccagaauaaagagggcgaccaguauauauacaugggucaaccauugaacaaugaugaagaccacgcucauuggaccgaggccaagauguuacuggauaacaucaauacacccgaggggauuaucccugcacucuuugaaccagagagggaaaagagcgccgcuaucgacggcgaguaucgccugagaggagaagccaggaaaacuuucguggagcuuaugcggcguggcgaucugcccguauggcucucguacaagguggcgucugagggguuucaguauuccgaccgccgauggugcuucgacggagaaagaaacaaucagguuuuggaggaaaacauggaugucgagauuuggaccaaagaaggugagaggaagaaacugcggccucgcuggcuagacgcaagaacauacagcgauccgcuggcccucagggaguuuaaggaauucgcugccggccggcgaucagugaguggggaccuuauacuggagaucggaaaauuaccacagcacuugacccugagagcucaaaaugcacucgauaaccuggugaugcuucacaauucugaacagggcgguaaggccuaucgccaugcuauggaggaacugcccgacacuauugagacgcucauguugcuggccuuaaucgcaguccuaaccgggggcguuacacuguuuuuccucuccggaaagggccuugggaaaacuagcauuggacuguugugugugauggcgucaagugcccugcucuggauggcuagcguagagccucacuggaucgccgcauccauaauccuggaauuuuuccuuauggugcuccugauucccgagccagauaggcagcggaccccucaggacaaccaauuggcuuacgucgugaucggucuguuauuuaugauucuaacaguugccgcaaaugaaaugggccugcucgagaccacuaagaaagaucuugggaucggacauguggccgcugagaaccaccaccaugcgacaaugcuggacgucgauuugcgucccgccucugcauggacgcuguacgcuguagccaccacugugauaacaccaaugaugagacacaccauugaaaacaccacagccaauaucagccucacugcaauugcuaaccaggccgcgauccugaugggccuugacaaggguuggccuauauccaaaauggauaucgggguuccguuacuggcucucggcugcuauucacaggugaaucccuugacgcugaccgccgcaguccuaaugcugguggcccauuacgcuauuaucggaccaggccuccaagcaaaggccacaagggaggcgcagaagcgcacugcugccgggauuaugaaaaacccuaccgucgacggaaucgugacaauagaccuugaucccguuguguaugacgcaaaguucgaaaaacagcugggccagauuauguugcugauccucuguaccucucaaauccuguuaaugcggacuacgugggcccuuugcgagaguauuacacuggcuaccgguccacucacuacccuaugggaagggucgccuggaaaguuuuggaauacaacuaucgccguaagcauggcaaacauauuccgaggcuccuaccuggcuggugccggcuuggcguucucucugaugaaaucacucgggggaggcagaagggggaccggagcccagggcgagacacuuggugagaaguggaagcgccagcugaaucaguugagcaaauccgaauuuaacacguauaagaaaagugggauuauggagguggaucggucugaagcaaaggagggacugaaaagaggcgaaaccacuaagcacgcugucagccgugguacagccaagcucaggugguucguugagcggaauuuagugaaacccgagggcaaggucaucgaccugggguguggacgcggcggguggucauacuauugcgcaggacuuaaaaaggugaccgaaguaaaaggcuacacuaagggugggccgggacaugaggaaccaauuccuauggcuacauacggcuggaaccuggugaaacuacacuccggcaaggauguuuuuuucacccccccagagaagugugacacgcuccugugcgauaucggggaaaguagccccaauccuaccauagaggagggacgaacauugagagugcugaaaauggucgaaccguggcucagggguaaccaauuuuguaucaagauucuuaaucccuauaugccaucuguggucgagacucuggaacagaugcagcggaaacacggcgggauguuagugcgcaacccucuguccagaaauucaacccaugagauguacuggguuagcugcggaacaggcaacaucguaucggccgugaauaugacuucuaggauguugcucaaccgauucaccauggcccaccggaagcccacauaugagcgugacgucgaucugggugcggggaccagacauguggcuguugaaccugagguggcaaaccuagacauuaucggacagcgcauugaaaauaucaaaaacgagcacaagaguacuuggcacuacgaugaagacaauccauauaagacgugggccuaccauggcuccuaugaggucaaacccagcggcucagcuuccucuauggugaacgggguagugaggcuucugacaaagccuugggacguuauaccaauggucacccaaauugccaugacugauaccacacccuuuggacagcagcggguguucaaagagaagguggacacgagaaccccgcgcgcaaaaagggguacugcccaaaucauggaagucacagcuaaguggcucuggggcuuucugagccgaaauaagaaaccucggaucuguaccagagaggaauucacuaggaagguucgcaguaacgcggccauuggggcaguguuuguagaugagaaucaguggaacuccgcuaaagaagccguggaggacgagcguuucugggauuugguccaccgggaaagagagcugcauaagcagggaaaaugcgcaacaugcguguacaauaugaugggcaagagggaaaagaaacucggugaguuugggaaggccaaaggaagccgcgcuauaugguacauguggcuuggcgcccgauuccuggaauucgaggcguuaggcuuuaugaacgaggaccacugguucucucgggaaaauucacugagugggguugagggagaagguuugcauaagcucggcuauauccugagagauauuuccaaaaucccagggggaaacauguacgcagacgauaccgccggcugggacacaaggauuacugaggaugaccuacagaaugaggcuaagaucaccgauauaauggaacccgagcacgcccuucuggcaacgagcaucuuuaaacucaccuaucaaaacaaggugguccgcgugcagagaccugcuaagucugguacaguaauggacguuauuucgcggagggaccagcgugggucaggacaggugggcacuuacggccugaauaccuucacaaacauggaaguccaauugauccgacagauggagagcgaagggauuuuuuccccaagugaguuagagacucccaaccuggccaaacgcgugcucgauuggcuugaaaagcacggaguggagagacugaaacggauggcuaucucuggugacgauugugucguuaagccgauagacgauagguucgccaccgcacuaacggcgcugaaugacaugggcaaagugcgcaaggauauuccucagugggaacccagcaagggguggaacgacuggcagcaaguaccauuuugcucccaucacuuccaucagcucaucaugaaagauggaagagagaucguggucccuugucggaaucaggacgaauuggugggcagggcccgaguuucacagggugcuggguggagucugcgugagacagccugccuuggaaagucuuaugcacaaauguggcagcugauguacuuucacagacgcgaucuccgguuagcugccaacgcaauuuguagcgccgugcccgucgacugggugccaaccuccaggacuacauggucaauacacgcgcaucaccaguggaugaccacugaggacaugcugagcguauggaauagaguuuggaucgaagagaaccccuggauggaagauaaaacccaugugucuuccugggaggaagucccuuauuugggcaagcgcgaggaccaauggugcggcagucugauugggcucacagcucgggccacgugggcaaccaauauccagguggccauuaaccagguuaggcgacuuaucggaaaugagaacuaccuggauuacaugacuagcaugaaaagauucaagaaugaaucggacccagagggugcucuaugguga

SEQ ID NO: 13231 - RNA, 9879 nt, Artificial Sequence
  derived and/or modified CDS sequence (opt3) from DENV-1__FJ850077__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagagguagaaccggacgauguggacuguuggugcaaugccaccgauacuugggucacauaugggaccuguagucaaacgggagagcaccgccgagacaagcguagcguggcgcuggcuccccauguuggcuugggucucgagacuagaaccgaaacauggauguccucugagggggccuggaaacaggugcagaaggucgaaacuugggcacugaggcacccuggauucaccgugaucgcccuguuucucgcucaugcaauuggcacaucgaucacccagaagggcauuaucuucauauuacugaugcuuguaacgccaucaauggccaugcggugcguugggaucggaaaccgcgauuuuguggaggguuugagcggcgcuacuugggucgacguggugcuggagcacgggaguugugucacaaccauggccaaaaauaagcccacucuagauauugaacuccugaaaacagagguuaccaacccugcggugcuuagaaagcugugcaucgaagcaaaaauuuccaauacgaccacagacucuagguguccaacucaaggagaggccaccuugguagaagagcaggaugcuaacuucgugugccggcgcacauuugucgaccgaggcugggguaauggguguggacucuucggcaagggcagccuguuaacuugcgccaaguuuaaaugcgugaccaagcuggaggggaaaaucguucaguacgaaaaccucaaguauuccgugauagucacagugcacaccggagaucagcaucaaguagguaaugagacuacggaacacggcacaauugcaaccaucacuccccaggcuccuaccucagagauucagcuuacagacuacggggcccugaccuuggacuguaguccaagaacuggacuagauuucaacgaaaugguucugcucacaaugaaagagaagagcuggcuggugcauaaacagugguuucuugaccugccguugcccuggacgucuggcgcguccaccucacaagagacuuggaauaggcaggaucuccuggucacauucaagaccgcccacgcaaagaaacaggaaguggucguguuagguagccaagagggggcuaugcacacagcccugacuggcgcuaccgaaauccagacgaguggaaccacaacuaucuuugccggccaucuaaagugccggcucaaaauggacaagcugacccuuaaagggaugucuuauguuauguguacaggauccuucaaguuggagaaggaaguggcagagacucagcacgguaccguacugguccaggugaaauacgagggcacggaugccccuugcaagauuccauuccucacacaagacgaaaaagggguuacccagaacggacgucugauaacugcuaaucccaucgugacagauaaggagaaaccugucaacauugaaaccgagccacccuuuggcgagagcuauaucgugguaggugcgggggaaaaggcacuuaagcugucgugguucaaaaagggcucuuccauaggaaaaauguuugaggccacugcucgcggcgccagaaggauggcaauuuugggggacaccgccugggauuucggaucaaucgguggccucuuuacaaguguggggaagcugauccaucagguuuucggaacggcuuacggcgucuuauuuagcgguguguccuggaccaugaaaauugggaucggcauucugcuaacuuggcucggacugaauucucggagcacaucacuuaguaugaccuguauagccgugggcauggucacauuguaccuggggguuauggugcaggcagacuccggaugcgugaucaacuggaagggccgagaacucaagugugguagcgggauuuucguaacuaacgagguccacaccuggacggaacaauauaaauuucaggcggauucuccgaagcgccugucagcugccaucggaaaagcaugggaggagggcgugugcgguaucagaagugccacaagguuagaaaauauuauguggaagcagauaagcaacgagcugaauuacauccuuuuggaaaacgacaugaaauucaccguuguggucggcgacgcuaaugggauucucacucagggaaagaaaaugauccggccucaacccauggagcauaaguauuccuggaagucuuggggcaaagccaagauuaucggggcagauauacagaacaccacauuuaucauugacggaccagauacuccugaaugucccgacgaucagcgcgcuuggaauaucugggagguggaggacuacggcuucgguauuuuuaccacaaacaucuggcugaaacuaagagauucguauacgcagaugugcgaccacaggcugaugagcgccgcgauaaaggauuccaaagccguucacgcugacaugggguacuggauugaaucagagaagaaugaaaccuggaagcucgcacgugccaguuucaucgaggugaaaacuuguauuuggccaaagucucauacacuguggagcaacggaguacuugaauccgagaugaucauacccaaaaucuauggcgguccuaccucacaacacaauuaccggccaggcuacuucacucagacagcugggccguggcauuugggaaagcuggaguuagauuuugaccucugcgaaggcaccacggucgugguggaugagcacugcggguaucgaggacccagccugagaacuaccacagucaccggcaaaauuauccacgaaugguguugcaggucuuguacucuuccuccacugcgcuuccggggugaggacgggugcugguacggaauggagauuagacccguuaaggaaaaggaggaaaacuuggugagguccaugguaagugccggcagcggugagguggacucuuuuucccucggcauccugugugucucaauacuaauugaagaggugaugcgcagucgauggagccggaaaaugcugaugacagggacccucgcaguuuuccugcuuuugaucaugggacagcugacauggaaugauuuaauccgucucugcauuauggugggcgcgaacgccucggacagaauggggaugggaacuaccuaucuggcucuuauggccacguuuaagaugaggccuauguucgcagucggccugcuauuucgcaaacucacaucccgggaggugcuguugcugaccaucgguuuaucucucguugcuagcguggaacugccaaauucacuugaggaacugggggauggauuggccaugggcauuaugaugcucaagcugcuaacugacuuccaaccccaucagcuguggaccacacuucucagucugacuuuuauaagaaccuccuugucucuggauuacgcauggaaaacgauggccauggcuuuaagcaucgucucccucuucccgcugugucuuucaacaaccagccagaagacuacauggcugccuguauugcucggcaguuuugggugcaagccacugaccauguuccuaauuacugagaacaggaucuggggacgaaaaucuuggcccauuaacgaaggugugauggcgguuggcaucguguccauacugcuuagcucgcuccugaagaaugacgucccuuuggccgggcccuuaaucgcaggaggcaugcugauugcuuguuaugugaucucagguucuagugccgaucucucccuggagaaagccgcugagguaagcugggaagaggaagcagagcacucugggacaagccauaacauucuuguggaaguccaggacgauggaaccaugaagaucaaagacgaggagcgcgaugacacgcugacuauauugcuaaaggccacccugcucgcgguuuccggcguguacccaaugucaauuccugcuacacuguuugugugguauuucuggcaaaaaaagaagcagcggaguggcguccuuugggauacccccagcccaccggaaguggagagagccguuuuagacgacgggaucuacaggauccugcagcguggacucuugggucgcucucagguaggcgugggggucuuccaagauggaguguuucacacaauguggcauguuacucggggcgcagugcugauguaccaggguaaaagacucgaaccuuccugggccucagucaagaaagaccugauuaguuaugggggaggcuggagguuccagggcagcuggaauaccggggaggaggugcagguaauagcugucgaacccggaaagaacccaaaaaaugugcaaacgacacccgguacuuuuaagaccccugagggcgaaguuggggcaaucgcccuugauuucaagccaggaacauccggcucucccauugugaaccgagaggguaaaaucgucgggcuguacggaaauggcgugguuaccacuucgggcaccuaugugagcgcgauugcucaggccaaggcaucacaggaagggccuuugccggagaucgaggacgaagucuuuaaaaagcggaaccuaacaauaauggaucugcacccaggauccgguaaaacgcgcagauaccuccccgccaucgugagggaggcuauuaagcggaaguuacgaacucugauccuugccccuaccagaguaguggcaagugaaauggcugaggcccugaaaggcaugccaauucgcuaucaaacaaccgcgguuaagucugaacacacugggagggagaucgucgaccucaugugccaugccacauucaccaugcguuugcugagccccgugcgggugccuaauuacaacaugauaauuauggaugaggcacacuuuacggacccggcuuccaucgccgcuagaggauauaucucaacuagggucggcaugggugaagcagccgccauuuucaugacagcuacccccccagggucuguagaggcguuuccucagagcaaugcagugauccaggaugaagagcgcgacauacccgaacgaaguuggaacuccggauacgauuggauuaccgacuucccaggcaaaacuguuugguuugugccuagcaucaagucuggcaaugacauugccaacugucucagaaaaaaugggaagcgggucauccagcugucaaggaagacauucgauaccgaguaccaaaaaacaaagaacaacgacugggauuaugugguuacuacggacauauccgagaugggagcuaauuuccgcgccgaucgugugauugaccccagacggugccuuaaaccagucauccuaaaggaugguccggaaagggugauccuggcaggcccuaugcccguaaccguggccagugcugcgcagcgccgagggagaauuggacggaaccagaauaaagagggcgaccaguacaucuauaugggucaaccauugaacaaugaugaagaccaugcccacuggacagaggcaaagauguuacuggauaacauuaauacucccgaggggauaaucccugcucucuuugaaccagagagggaaaagagcgccgcaauugacggcgaguaccgccugagaggagaagccaggaaaaccuucguugagcuuaugcggcguggcgaucugcccgucuggcucucguauaagguggcuucugagggguuucaguacuccgaccgccgauggugcuucgacggagaaagaaacaaucagguguuggaggaaaacauggaugucgagaucuggacaaaagaaggugagaggaagaaacugcggccucgcuggcuagacgccagaaccuauagcgauccgcuggcgcucagggaguuuaaggaauucgcagccggccggcgaucaguuaguggggaccuuauccuggagauuggaaaauuaccacagcauuugacucugagagcucaaaaugcccucgauaaccuggugaugcuucacaauucugaacagggcgguaaggcuuaccgccacgcaauggaggaacugcccgacacgauagagacccucauguugcuggccuuaaucgcuguacuaacagggggcgugacucuguuuuuccucuccggaaagggccuugggaaaaccagcauuggacuguugugugucauggccucaagugcacugcucuggauggcgagcguggagccucauuggaucgccgcuuccauuauccuggaauuuuuccuuaugguucuccugauacccgagccagauaggcagcggacaccucaggacaaccaauuggccuacguggucaucggucuguuauuuaugauucuaaccguagcagcuaaugaaaugggccugcucgagacuacaaagaaagaucuugggaucggacacguggccgcagagaaccaucaccacgccacgaugcuggacguugauuugcgucccgcuucugcguggacccuguaugccguggcaacuacagucauuaccccaaugaugagacauaccaucgaaaacacaacugcuaauauaagccucacggccauugccaaccaggcagcuauccugaugggccuugacaaggguuggccuauuuccaaaauggauaucggggugccguuacuggcccucggcugcuacucacaggucaaucccuugacccugacagcgacugugcuaaugcugguugcucacuaugccauaaucggaccaggccuccaagcaaaggccaccagggaggcucagaagcgcacagcagccgggauuaugaaaaacccuaccguggacggaaucguaacuauugaccuugaucccguggucuacgacgcgaaguucgaaaaacagcugggccagaucauguugcugauacucuguacgucucaaauucuguuaaugcggacaaccugggcucuuugcgagaguaucacucuggccaccgguccacucacaacucuaugggaagggucgccuggaaaguuuuggaauaccacaaucgcaguuagcauggccaacauuuuccgaggcuccuaucuggcuggugccggcuuggcauucucucugaugaaaucacucgggggaggcagaagggggacgggagcucagggcgagacccuuggugagaaguggaagcgccagcugaaucaguugagcaaauccgaauuuaacacuuacaagaaaagugggaucauggagguggaucggucugaagccaaggagggacugaaaagaggcgaaacaaccaagcaugcggucagccgugguacugccaagcucaggugguucguggagcggaauuuaguaaaacccgagggcaaggugauagaccugggguguggacgcggcggguggucauauuacugcgcaggacuuaaaaagguuacagaagugaaaggcuacaccaagggugggccgggacacgaggaaccaauuccuauggcuacguauggcuggaaccuggucaaacuacauuccggcaaggauguguuuuucacccccccagagaagugugacacacuccugugcgauaucggggaaaguagccccaauccuacuauugaggagggacgaaccuugagaguccugaaaaugguggaaccguggcucagggguaaccaauuuuguaucaagauacuuaaucccuacaugccaucuguuguagagacacuggaacagaugcagcggaaacacggcgggauguuagugcgcaacccucuguccagaaauucaacucacgagauguauugggucagcugcggaaccggcaacaucgugucggccguuaauaugacaucuaggauguugcucaaccgauucaccauggcacaucggaagcccacuuacgagcgugacguggaucugggugcugggacgagacacgucgccguggaaccugagguagccaaccuagacauuaucggacagcgcauugaaaauaucaaaaacgagcauaagaguacauggcacuaugaugaagacaauccauacaagaccugggcguaucacggcuccuacgaggugaaacccagcggcucagcuuccucuaugguuaacggggucgugaggcuucugacuaagccuugggacgugauuccaauggucacccaaaucgcaaugacagauacgacccccuuuggacagcagcggguuuucaaagagaagguggacacuagaacaccgcgcgccaaaagggguaccgcucaaauaauggaaguaacugccaaguggcucuggggcuuucugagccgaaauaagaaaccucggauuuguacaagagaggaauucaccaggaaggugcgcaguaacgcagccaucggggcugucuuuguggaugagaaucaguggaacuccgcgaaagaagccguugaggacgagcguuucugggauuuggugcaucgggaaagagagcugcacaagcagggaaaaugcgcaacaugcgucuacaauaugaugggcaagagggaaaagaaacucggugaguuugggaaggcuaaaggaagccgcgccaucugguauauguggcuuggcgcacgauuccuggaauucgaggccuuaggcuuuaugaacgaggaccauugguucucucgggaaaauucacugagugggguggagggagaagguuugcacaagcucggcuacauucugagagauauauccaaaaucccagggggaaacauguaugcugacgauacugccggcugggacaccaggauuacggaggaugaccuacagaaugaggcgaagaucaccgauauuauggaacccgagcaugcacuucuggccacaagcaucuuuaaacucacuuaccaaaacaagguaguucgcgugcagagaccugcuaagucugguaccgucauggacgugauaucgcggagggaccagcgugggucaggacaggugggcacauauggccugaauacuuucaccaacauggaaguccaauugauccgacagauggagagcgaagggauuuuuuccccaagugaguuagagacgcccaaccuggccaaacgcguucucgauuggcuugaaaagcacggagcagagagacugaaacggauggcuaucucuggugacgauugugugguaaagccgauugacgauagguucgccacagcucuaaccgcccugaaugacaugggcaaagugcgcaaggauaucccucagugggaacccagcaagggguggaacgacuggcagcaagucccauuuugcucccaccauuuccaccagcucauaaugaaagauggaagagacauugugguuccuugucggaaucaggaugaguuggugggcagggcacgagucucacagggugcgggguggagucugcgugaaacugccugccuuggaaagucuuacgcucaaauguggcagcugauguauuuucauagacgcgaccuccgguuagccgcaaacgcuaucuguagcgccgugcccguagacuggguuccaacauccaggaccacuuggucaauccacgcacaccaucaguggaugaccacagaggauaugcugagcguguggaauagagucuggauugaggaaaaccccuggauggaggacaaaacgcacgugucuuccugggaagagguuccuuacuugggcaagcgcgaagaucaauggugcggcagucugauagggcucaccgcccgggcgacuugggcuacaaauauccagguggccauuaaccaggucaggcgacuuaucggaaaugagaacuaccuggacuauaugaccagcaugaaaagauucaagaaugagucggauccagaaggugcacuaugguga

SEQ ID NO: 13232 - RNA, 9879 nt, Artificial Sequence
  derived and/or modified CDS sequence (opt3) from DENV-1__FJ850081__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgccaaugggauccucgcacagggaaagaaaaugauucggccucaacccauggagcauaaguauuccuggaagucuuggggcaaagcuaagaucauaggggccgauauccagaacacuaccuuuauuaucgacggaccagauacaccugaaugucccgacgaucagcgcgcguggaauauuugggagguggaggacuacggcuucgguaucuuuacuaccaacauauggcugaaacuaagagauucgcacacacagaugugcgaccacaggcugaugagcgccgcuauuaaggauuccaaagcaguccaugccgacaugggguauuggaucgaaucagagaagaaugaaacguggaagcucgcucgugccaguuucauugaggugaaaaccuguaucuggccaaagucucacacucuguggagcaacggaguucuugaauccgagaugauaauccccaaaauuuacggcgguccuaucucacaacauaauuaucggccaggcuacuucacacagaccgcagggccguggcacuugggaaagcuggaguuagauuuugaccucugcgaaggcacuacagugguagucgaugagcacugcggguaccgaggacccagccugagaaccacgacugugaccggcaaaauuauccaugaaugguguugcaggucuuguacacuuccuccacugcgcuuccggggugaggacgggugcugguauggaauggagauaagacccgugaaggaaaaggaggaaaacuuggucagguccaugguuagugcgggcagcggugagguggacucuuuuucccucggcauucuguguguaucaauccuaaucgaagaggugaugcgcagucgauggagccggaaaaugcugaugaccgggacucucgccgucuuccugcuuuugauuaugggacagcugacauggaaugauuuaauccgucucugcauuauggugggcgcuaacgccucggacagaauggggaugggaaccacauaccuggcacuuauggcuacuuuuaagaugaggccuauguucgccguuggccugcuauuucgccggcucaccuccagagaggugcuguugcugacgauagguuuaucucucgucgcaagcguggaacugccaaauucacuugaggaacugggggauggauuggccaugggcaucaugaugcucaaacugcuaacagacuuccaaccccaccagcuguggaccacucuucucagucugaccuuuauuaggacauccuugucucuggauuaugcuuggaagacuauggcgauggccuuaagcaucguuucccucuucccgcugugucuuucaaccacgagccagaaaacaaccuggcugccuguguugcucggcaguuuugggugcaagccacugacuauguuccuaauuacagagaacaagaucuggggacgaaaaucuuggcccauaaacgaagguaucauggcagucggcauuguauccauccugcuuagcucgcuccugaagaaugacgugccuuuggcugggcccuuaauugccggaggcaugcugaucgccuguuacguuauaucagguucuagugcugaucucucccuggagaaagcagccgaggugagcugggaagaggaagcggagcauucugggaccagccacaacauucuugucgaagugcaggacgauggaacuaugaagaucaaagacgaggagcgcgaugacacacugaccaucuugcuaaaggcuacgcugcucgccguauccggcguguauccaaugucaauuccugcaacucuguuugucugguacuucuggcaaaaaaagaagcagcggaguggcguucuuugggauacccccagcccaccggaaguggagagagccguguuagacgacgggauauauaggauccugcagcguggacucuugggucgcucucaggucggcguggggguuuuccaagauggaguauuucauacaauguggcacgugacccggggcgcuguccugauguaccaggguaaaagacucgaaccuuccugggcaucagugaagaaagaccugauuaguuacgggggaggcuggagguuccagggcagcuggaauacaggggaggagguucaggugaucgccgucgaacccggaaagaacccaaaaaaugugcaaacuacccccgguacguuuaagacaccugagggcgaaguaggggcgauugcucuugauuucaagccaggaacuuccggcucucccaucgucaaccgagaggguaaaauaguggggcuguauggaaauggcguugugaccacaucgggcaccuacgucagcgccaucgcacaggccaaggcuucacaggaagggccuuugccggagauugaggacgaaguguuuaaaaagcggaaccuaacuaucauggaucugcacccaggauccgguaaaacccgcagauaucuccccgccauuguuagggaggcaaucaagcggaaguuacgaacacugauacuugcuccuacgagaguggucgccagugaaauggcggaggcccugaaaggcaugccaauucgcuaccaaacuaccgcagugaagucugaacauacagggagggagaucguagaccucaugugccacgcuaccuucacuaugcguuugcugagccccgugcggguuccuaauuauaacaugaucauuauggaugaggcccauuuuacagacccggcuuccaucgcagccagaggauacauaucaaccagggucggcaugggugaagccgcugcgauuuucaugacggcaacucccccagggucugccgaggcuuuuccucagagcaaugccgugauccaggaugaagagcgcgacauucccgaacgaaguuggaacuccggauaugauuggaucacagacuucccaggcaaaaccgugugguuugucccuagcauaaagucuggcaaugacauugcaaacugucucagaaaaaaugggaagcggguaauccagcugucaaggaagaccuucgauacugaguaccaaaaaacaaagaacaacgacugggauuacgugguuaccacagacaucuccgagaugggagccaauuuccgcgcugaucgugugauugaccccagacggugccuuaaaccagucauccuaaaggaugguccggaaagggugauucuggcgggcccuaugcccguuacuguggccagugcagcucagcgccgagggagaauaggacggaaccagaauaaagagggcgaccaguauaucuacaugggucaaccauugaacaaugaugaagaccacgcccauuggacggaggcaaagauguuacuggauaacauuaauacccccgaggggaucaucccugcccucuuugaaccagagagggaaaagagcgcugccauugacggcgaguaucgccugagaggagaagcgaggaaaacauucgucgagcuuaugcggcguggcgaucugcccguguggcucucguacaagguagcaucugagggguuucaguauuccgaccgccgauggugcuucgacggagaaagaaacaaucagguguuggaggaaaacauggauguugagauauggacuaaagaaggugagaggaagaaacugcggccucgcuggcuagacgccagaaccuacagcgauccgcuggcucucagggaguuuaaggaauucgccgcuggccggcgaucagucaguggggaccuuauccuggagauuggaaaauuaccacagcacuugacacugagagcacaaaaugcccucgauaaccuggugaugcuucacaauucugaacagggcgguaaggcuuaucgccaugccauggaggaacugcccgacaccaucgagacucucauguugcuggcauuaauugcggugcuaacggggggcgucacccuguuuuuccucuccggaaagggccuugggaaaacaagcaucggacuguuguguguuauggccucaagugcucugcucuggauggccagcguggagccucacuggauagcagcuuccaucauucuggaauuuuuccuuaugguacuccugauccccgagccagauaggcagcggacuccucaggacaaccaauuggccuacguggucauuggucuguuauuuaugauccuaaccguggcagccaaugaaaugggccugcucgagacaaccaagaaagaucuugggauaggacauguugcugcggagaaccaccaccaugccacuaugcuggacguggauuugcgucccgcaucugcuuggacacuguacgccgucgccacgaccguaauuacuccaaugaugagacacacaaucgaaaacaccaccgcaaauauuagccucacagcuaucgccaaccaggcggcuauacugaugggccuugacaaggguuggccuaucuccaaaauggauauuggggugccguuacuggcccucggcugcuauucacagguuaaucccuugacucugacggcagccgugcuaaugcuggucgcucauuacgcaaucauuggaccaggccuccaagccaaggcgaccagggaggcucagaagcgcacagccgcagggaucaugaaaaacccuacuguggacggaauagucaccauugaccuugaucccgugguuuaugacgccaaguucgaaaaacagcugggccagaucauguugcugauccucuguacaucucaaauucuguuaaugcggaccacuugggcucuuugcgagaguaucacgcuggccacagguccacucaccacucuaugggaagggucgccuggaaaguuuuggaauaccacaauagcagugagcauggcuaacauuuuccgaggcuccuaccuggccggugcgggcuuggccuucucucugaugaaaucacucgggggaggcagaagggggacuggagcacagggcgagacccuuggugagaaguggaagcgccagcugaaucaguugagcaaauccgaauuuaacacauauaagaaaagugggaucauggagguagaucggucugaagcuaaggagggacugaaaagaggcgaaacgaccaagcacgccgugagccgugguacugcaaagcucaggugguucgucgagcggaauuuaguuaaacccgagggcaaggugauugaccugggguguggacgcggcggguggucauacuauugcgcuggacuuaaaaaggucacagaagugaaaggcuacaccaagggugggccgggacaugaggaaccaaucccuauggccacuuacggcuggaaccugguaaaacuacacuccggcaaggauguguuuuucacacccccagagaagugugacacccuccugugcgauauaggggaaaguagccccaauccuacgaucgaggagggacgaaccuugagaguucugaaaaugguggaaccguggcucagggguaaccaauuuuguauuaagauccuuaaucccuauaugccaucugucguggagacacuggaacagaugcagcggaaacacggcgggauguuaguccgcaacccucuguccagaaauucaacucaugagauguacugggugagcugcggaaccggcaacauuguuucggccguaaauaugacaucuaggauguugcucaaccgauucacuauggcgcaccggaagcccaccuaugagcgugacguggaucugggugcugggacaagacaugucgcaguggaaccugagguugccaaccuagacaucauuggacagcgcaucgaaaauauaaaaaacgagcacaagaguaccuggcacuacgaugaagacaauccauauaagacuugggcuuaccauggcuccuaugaggugaaacccagcggcucagccuccucuauggucaacggggugguaaggcuucugacgaagccuugggacgugauuccaaugguuacacaaaucgcaaugaccgauacuacccccuuuggacagcagcgggucuucaaagagaagguggacacaagaacgccgcgcgccaaaagggguaccgcucaaaucauggaagugacugcgaaguggcucuggggcuuucugagccgaaauaagaaaccucggauuuguacaagagaggaauucaccaggaagguccgcaguaacgccgcaauaggggcuguuuuuguggaugagaaucaguggaacuccgccaaagaagcaguagaggacgagcguuucugggauuuggugcaccgggaaagagagcugcauaagcagggaaaaugcgccacuugcgucuacaauaugaugggcaagagggaaaagaaacucggugaguuugggaaggcuaaaggaagccgcgccaucugguacauguggcuuggcgcgcgauuccuggaauucgaggcauuaggcuuuaugaacgaggaccacugguucucucgggaaaauucacugagugggguggagggagaagguuugcauaagcucggcuauauucugagagauaucuccaaaauuccagggggaaacauguacgccgacgauacagcuggcugggacaccaggaucacagaggaugaccuacagaaugaggccaagauaacugauaucauggaacccgagcacgcacuucuggcuaccagcauuuuuaaacucacguaucaaaacaagguugugcgcguccagagaccugccaagucugguaccgugauggacguaaucucgcggagggaccagcgugggucaggacagguuggcacauacggccugaauacuuucaccaacauggaagugcaauugauucgacagauggagagcgaagggaucuuuuccccaagugaguuagagacacccaaccuggcuaaacgcguccucgauuggcuugaaaagcacggagccgagagacugaaacggauggcaauaucuggugacgauuguguggugaagccgauugacgauagguucgcgacugcccuaaccgcucugaaugacaugggcaaaguccgcaaggauaucccucagugggaacccagcaagggguggaacgacuggcagcaaguuccauuuugcucccaucacuuccaucagcucaucaugaaagauggaagagagauugugguaccuugucggaaucaggacgaauuggugggcagggcccgagucucacagggugcaggguggagucugcgugagacggcuugccuuggaaagucuuaugcccaaauguggcagcugauguacuuucacagacgcgaucuccgguuagcagccaacgcgauauguagcgcugugcccguugacugggugccaacauccaggaccacuuggucaauccacgcccaucaccaguggaugacaaccgaggacaugcugagcgucuggaauagaguguggauugaagagaaccccuggauggaagauaaaacucauguaucuuccugggaggaaguuccuuauuugggcaagcgcgaggaccaauggugcggcagucugaucgggcucaccgcacgggccacaugggcuacgaauauucagguggccaucaaccaggucaggcgacuuauaggaaaugagaacuaccuggauuacaugaccagcaugaaaagauucaagaaugaaucggacccagagggugcacuaugguga

SEQ ID NO: 13233 - RNA, 9879 nt, Artificial Sequence
  derived and/or modified CDS sequence (opt3) from DENV-1__FJ850084__SS-prME
agcgugaccaugcugcucaugcuucugcccacagccuuggcuuuccacuuaacuacgagaggcggggaaccucauaugaucgucuccaagcaggaaagaggcaaaucucugcuguuuaagaccucaguuggugugaacaugugcacacucauugcuauggaccugggcgaacuuugugaagauacuaugaccuacaaaugcccacggauuacagaaguagaaccggacgauguggacuguuggugcaaugccaccgauacuugggucacauaugggaccuguagucaaacgggagagcaccgccgagacaagcguagcguggcgcuggcuccccauguuggcuugggucucgagacuagaaccgaaacauggauguccucugagggggccuggaaacagauccagaagguggaaacuugggcccugaggcacccuggauucaccgucauugcccuguuucucgcucaugcaaucggcacaucgauuacccagaagggcaucauauucaucuuacugaugcuugugacgccaucaauggccaugcggugcguagggauuggaaaccgcgauuuuguugaggguuugagcggcgcuacuuggguggacgucgugcuggagcacgggaguugugugacaaccauggccaaaaauaagcccacucuagauaucgaacuccugaaaacagaggucaccaacccugcgguucuuagaaagcugugcauugaagcaaaaaucuccaauacgaccacagacucuagguguccaacucaaggagaggccaccuugguggaagaacaggaugcuaacuucguaugccggcgcacauuuguggaccgaggcugggguaauggguguggacucuucggcaagggcagccuguuaacuugcgccaaguuuaaaugcgucaccaagcuggaggggaaaauagugcaguacgaaaaccucaaguauuccguuauugugacaguccacaccggagaucagcaucaaguggguaaugagacuacggaacacggcacaaucgcaaccauuacuccccaggcuccuaccucagagauccagcuuacagacuacggggcccugaccuuggacuguaguccaagaacuggacuagauuucaacgaaaugguacugcucacaaugaaagagaaaagcuggcugguucauaaacagugguuucuugaccugccguugcccuggacgucuggcgcguccaccucacaagaaacuuggaauaggcaggaucuccuggugacauucaagaccgcccacgcaaagaaacaggaagucguggucuuagguagccaagagggggcuaugcacacagcccugacuggcgcuaccgaaauccagacgaguggaaccacaacuauuuuugccggccaucuaaagugccggcucaaaauggacaagcugacccuuaaagggaugucuuaugugauguguacaggauccuucaaguuggagaaggaaguugcagagacucagcacgguaccgugcugguacaggucaaauacgagggcacggaugccccuugcaagauaccauuccucacacaagacgaaaaaggggugacccagaacggacgucugaucacugcuaaucccauuguuacagauaaggagaaaccugugaacaucgaaaccgagccacccuuuggcgagagcuauauagucgugggugcgggggaaaaggcacuuaagcugucgugguucaaaaagggaucuuccauuggaaaaauguuugaggccacugcucgcggcgccagaaggauggcaaucuugggggacaccgccugggauuucggaucaaucgguggccucuuuacaaguguagggaagcugauucaucagguguucggagcugccuacggcguuuuauuuagcggugucuccuggacgaugaaaaucgggauuggcauacugcuaaccuggcucggacuaaauucucggagcacuucacuuaguaugacauguaucgcagugggcauggugaccuuguaccugggggucaugguucaggcggacuccggaugcgugauuaacuggaagggccgagaacucaagugugguagcgggaucuucgugacaaacgagguacacacuuggaccgaacaauauaaauuucaggcugauucuccgaagcgccugucagccgcaaucggaaaagccugggaggagggcgucugcgguauuagaagugcuacgagguuagaaaauauaauguggaagcagaucagcaacgagcugaauuacauucuuuuggaaaacgacaugaaauucacagugguugugggcgacgccaaugggauccucacccagggaaagaaaaugauucggccucaacccauggagcauaaguauuccuggaagucuuggggcaaagcaaagaucauaggggcugauauccagaacacuaccuuuauuaucgacggaccagauacaccugaaugucccgacgaucagcgcgccuggaauauuugggaggucgaggacuacggcuucgguaucuuuacuaccaacauauggcugaaacuaagagauucguauacacagaugugcgaccacaggcugaugagcgcggccauuaaggauuccaaagcugugcacgcagacaugggguacuggaucgaaucagagaagaaugaaacguggaagcucgcccgugcuaguuucauugagguuaaaaccuguaucuggccaaagucucauacucuguggagcaacggagugcuugaauccgagaugauaauccccaaaauuuauggcgguccuacaucacaacacaauuaccggccaggcuacuucacccagacugccgggccguggcauuugggaaagcuggaguuagauuuugaccucugcgaaggcacaaccguagucguggaugagcacugcggguaucgaggacccagccugagaacgacuaccgugacaggcaaaaucauucacgaaugguguugcaggucuuguacccuuccuccacugcgcuuccggggugaggacgggugcugguacggaauggagaucagacccgucaaggaaaaggaggaaaacuugguuagguccauggugagugcaggcagcgcggagguagacucuuuuucccucgguauacugugugugucaauucuaaucgaagaggucaugcgcagucgauggagccggaaaaugcugaugacuggcacacucgccguguuccugcuuuugaucauggggcagcugaccuggaaugauuuaauucgucucugcaucaugguuggagcuaacgccucggacagaaugggcauggggacaacuuaucuggcacuuauggcuaccuuuaagaugaggccuauguucgccgugggacugcuauuucgcaaacucacgucccgggagguccuguugcugacaauuggcuuaucucucguggcaagcguugaacugccaaauucacuugaggaacugggugauggguuggccaugggaauaaugaugcucaagcugcuaaccgacuuccaaccccaucagcuguggacuacccuucucagucugacauuuaucagaacuuccuugucucuggauuacgcuuggaaaaccauggcgauggccuuaagcauugugucccucuucccgcugugucuuucaacgacaagccagaagaccacuuggcugccugucuugcucggcaguuuuggcugcaagccacugacaauguuccuaaucaccgagaacaaaauuugggggaggaagucuuggcccaucaacgaaggaauaauggcaguagguaucguguccauucugcuuagcucgcuccugaaaaaugacguuccuuuggcuggccccuuaaucgccgggggaaugcugauugccuguuaugugaucucaggcucuagugcugaucucucccuggagaaggcagccgaggucagcugggaagaggaagcggagcacucugguacuagccauaacauacuuguggaaguacaggacgaugggacaaugaaaauuaaggacgaggagcgagaugacacccugacgaucuugcuaaaagcuacucugcucgccguguccggagucuacccaaugucaaucccugcaacccuguuuguuugguauuucuggcaaaagaagaaacagcgcaguggcgugcuuugggauacacccagcccaccggaaguggagcgggccgucuuagacgacggcauuuacagaauacugcagagggggcucuugggacguucucagguggguguuggcguauuccaagaugggguguuucacaccauguggcaugucacacgcggagcugugcugauguaccagggcaagcggcucgaaccuuccugggcaucaguuaaaaaggaccugaucaguuauggugggggauggagauuccagggcagcuggaauacuggcgaggaggugcaggucauugccguggaacccgggaaaaacccaaagaauguacaaaccacgcccggaacauuuaagacuccugagggugaagucggcgcgaucgcucuugauuucaaaccagggaccuccggaucucccauugugaacagggagggcaagaucguuggucuguacgggaauggaguggucacaaccucgggcacuuaugugagcgccauagcacaggccaaggcuucacaggaaggcccuuugccggagaucgaggacgaaguuuuuaagaaacgaaaccuaaccauuauggaucugcacccaggguccggaaagacacggcgcuaccuccccgccaucgugagagaggcaauuaagaggaaauuacggacgcugauccuugcuccuacucgagucguggccagugaaauggcggaggcccugaaggguaugccaauaagauaucaaaccacagcaguaaaaucugaacacaccggccgcgagauuguggaccucaugugccaugcuacuuucacaaugagguugcugagccccguucgugucccuaauuacaacaugaucaucauggaugaggcccacuuuaccgacccggcuuccauugcagcccggggguauaucucaacgagagugggaaugggcgaagccgcugcgauauucaugacugcaacacccccagguucuguggaggccuuuccucagagcaaugcugucauucaggaugaagagagggacauccccgaacgcaguuggaacuccggguacgauuggauuaccgacuucccaggaaagaccguaugguuugugccuagcaucaaaucuggcaaugacauagccaacugucuccgaaagaauggcaagagaguuauucagcugucacggaaaacuuucgauacagaguaccaaaagaccaaaaacaacgacugggauuauguggucacaacugacaucuccgagaugggggcaaauuucagggccgaucgcgugaucgacccccguagaugccuuaagccaguuauucuaaaagauggaccggaacgggugauccuggcugguccuaugcccgucacgguggcgagugccgcacagaggcgcggccgaauugggagaaaccagaauaaggagggagaccaguacauauauaugggccaaccauugaacaaugaugaagaccaugcucacuggaccgaggccaagauguuacuggauaacaucaauacacccgaggguauuaucccugcacucuuugaaccagagcgggagaaaagcgccgcuaucgacggggaguacaggcugcgcggcgaagccagaaagacuuucguagagcuuaugaggcggggagaucugcccguguggcucucguauaaaguugcgucugagggcuuucaguacuccgaccgucgcuggugcuucgacggggaacgaaacaaucaggucuuggaggaaaacauggauguggagauuuggaccaaggaaggagagaggaaaaagcugaggccucgguggcuagacgcacgcacauauagcgauccgcuggcccucagagaguuuaaagaguucgcugccgguaggcggucagugaguggcgaccuuauacuggagaucgggaaguuaccacagcauuugacccugcgagcucaaaaugcacucgauaaccuggucaugcuucacaauucugaacagggaggcaaggccuacagacacgcuauggaggaacugcccgacacuauugagacgcucauguugcuggccuuaaucgcaguucuaaccgguggggugacacuguuuuuccucuccggcaaaggacuuggcaagacuagcauugggcuguuguguguaauggcgucaagugcccugcucuggauggcuagcguggagccucauuggaucgccgcauccauaauccuggaauuuuuccuuaugguccuccugauucccgagccagaucgccagaggaccccucaggacaaccaauuggcuuacgugguuaucggacuguuauuuaugauucuaacaguggccgcaaaugaaaugggucugcucgagaccacuaaaaaggaucuuggcaucgggcacgucgccgcugagaaccaucaccacgcgacaaugcuggacguagauuugcggcccgccucugcauggacgcuguaugcuguggccaccacuguuauaacaccaaugaugcgucauaccauugaaaacaccacagccaauaucagccucacugcaauugcuaaccaggccgcgauccugaugggacuugacaaaggcuggccuauauccaagauggauaucggugugccguuacuggcucucgggugcuacucacaggucaaucccuugacgcugaccgccacagugcuaaugcuggucgcacacuaugccauuaucggcccaggacuccaagcuaaggcaacuagagaggcccagaaaaggaccgcggcuggcauuaugaagaacccuacaguggacgggaucguuaccauagaccuugaucccgugguauacgacgccaaauucgaaaagcagcugggacagauuauguugcugauccucuguacuucucaaauccuguuaaugcgcacgacaugggcacuuugcgagaguauuacccuggccacuggcccacucaccacacuaugggaagguucgccugggaaauuuuggaauacuaccaucgcugugagcauggccaacauauuccggggauccuaucuggcaggcgcugguuuggccuucucucugaugaagucacucggcgggggacgaagaggcacaggggcgcagggagagacgcuuggcgagaaguggaaaaggcagcugaaucaguugagcaaguccgaauuuaacaccuacaaaaagagugguauuauggaggucgaucgcucugaagccaaagaggggcugaagcggggagaaacuacaaagcaugcaguuagcagaggcaccgcuaaacuccguugguucguggagaggaauuuagucaagcccgaggguaaagugaucgaccugggcugugggcggggaggcuggucauauuacugcgccgggcuuaagaaaguaacugaagugaagggauacacaaaaggcgguccggggcacgaggaaccaauuccuauggcaaccuauggauggaaccugguuaagcuacauuccggcaaggauguguuuuucacgcccccagagaaaugugacacccuccugugcgauaucggcgaaaguagccccaauccuacaauagaggaggggcgcacuuugcgaguccugaagaugguggaaccguggcucagaggaaaccaauuuuguaucaaaauucuuaaucccuacaugccaucugucguggagacccuggaacagaugcagaggaagcacgguggcauguuaguucggaacccucugucccgcaauucaacacacgagauguauuggguaagcugcgggacuggaaacaucgugucggcugucaauaugaccucuagaauguugcucaacagguucacaauggcccaucgaaaacccaccuacgagcgggacguggaucugggcgccgguacucgucacguugcgguggaaccugaggucgcuaaccuagacauuaucgggcagagaauugaaaauaucaagaacgagcauaagaguacguggcacuaugaugaagacaauccauacaaaacaugggcauaucacggauccuacgaggugaagcccagcggcucagccuccucuaugguaaacggcgugguucgccuucugaccaaaccuugggacgucauaccaauggugacucaaauugcuaugaccgauacaacgcccuuugggcagcagaggguguucaaggagaaagucgacacccggacuccgagagccaagcgcggaacagcacaaaucauggaaguuaccgccaaguggcucugggguuuucugagcaggaauaaaaagccucgaaucuguacucgggaggaguucacaagaaaagugaggaguaacgcugcgauuggcgccguauuuguggaugagaaucaguggaacuccgcaaaggaagcugucgaggacgagcgcuucugggauuuggugcaucgugaacgggagcugcacaaacaggggaagugcgcaaccugcguuuacaauaugaugggaaagagagagaaaaagcucggcgaguuugguaaagcaaaggggagcagggccauaugguauauguggcuuggagcucgcuuccuggaguucgaggccuuaggcuuuaugaacgaggaccauugguucucucgagaaaauucacugaguggcguggagggggaaggauugcacaaacucgguuacauccugcgggauauuuccaagaucccaggcgggaacauguaugcggacgauacagcaggaugggacacuagaauuaccgaggaugaccuacagaaugaggccaaaaucacggauauaauggaacccgagcaugcacuucuggccaccagcaucuuuaagcucacauaccaaaacaaggucgugaggguacagcgcccugcaaaaucuggcacuguuauggacgugauuucgagacgggaccagagggguucagggcaggucggaaccuauggccugaauacauucacuaacauggaagugcaauugauccgucagauggagagcgaaggcauauuuuccccaagugaguuagagacccccaaccuggcuaagcgagugcucgauuggcuugaaaaacacggggccgagcgccugaagagaauggcuaucucuggagacgauugugucguuaaaccgauagacgaucgguucgccacggcacuaacagcgcugaaugacauggguaaggugaggaaggauauuccucagugggaacccagcaaaggcuggaacgacuggcagcaaguaccauuuugcucccaccauuuccaccagcucaucaugaaggaugggcgcgacaucguggucccuuguagaaaucaggaugaguuggugggacgggccaggguuucacagggcgcugguuggagucugcgagaaaccgccugccuugggaaaucuuacgcacaaauguggcagcugauguauuuucaucguagagaccuccgcuuagcugccaacgcaauuuguagcgccgugcccgucgacugggugccaacuucccggacaaccuggucaauacacgcgcaccaucaguggaugacuaccgaggauaugcugagcguauggaauaggguuuggaucgaggaaaaccccuggauggaggacaagacacacgugucuuccugggaagaggucccuuacuugggaaaaagagaagaucaauggugcggcagucugauuggccucacggcucgcgccaccugggcaacuaauauccagguggccauuaaccagguucggaggcuuaucgggaaugagaacuaccuggacuauaugacaagcaugaagcgauucaagaaugagucggauccagaaggagcucuaugguga

SEQ ID NO: 13234 - RNA, 9879 nt, Artificial Sequence
  derived and/or modified CDS sequence (opt3) from DENV-1__FJ850087__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgugaaugggauccucgcccagggaaagaaaaugauucggccucaacccauggagcauaaguauuccuggaagucuuggggcaaagcaaagaucauaggggcugauauccagaacacuaccuuuauuaucgacggaccagauacaccugaaugucccgacgaucagcgcgccuggaauauuugggaggucgaggacuacggcuucgguaucuuuacuaccaacauauggcugaaacuaagagauucgcacacacagaugugcgaccacaggcugaugagcgcggccauuaaggauuccaaagcugugcaugcagacaugggguauuggaucgaaucagagaagaaugaaacguggaagcucgcccgugcuaguuucauugagguuaaaaccuguaucuggccaaagucucacacucuguggagcaacggagugcuugaauccgagaugguaauacccaaaaucuacggcgguccuauuucacaacauaauuaucggccaggcuacuucacacagaccgccgggccguggcacuugggaaagcuggaguuagauuuugaccucugcgaaggcacuacagucgugguggaugagcacugcggguaccgaggacccagccugagaaccacgacugucaccggcaaaaucauucaugaaugguguugcaggucuuguacacuuccuccacugcgcuuccggggugaggacgggugcugguauggaauggagaucagacccguuaaggaaaaggaggaaaacuuggugagguccaugguaagugcaggcagcggugagguggacucuuuuucccucggcauacugugugucucaauucuaaucgaagaggugaugcgcagucgauggagccggaaaaugcugaugaccgggacucucguuguguuccugcuuuugaucaugggacagcugacauggaaugauuuaauucgucucugcaucauggucggcgcgaacgccucggacagaauggggaugggaaccacauaccuggcucuuauggccacuuuuaagaugaggccuauguucgcagugggccugcuauuucgccggcucaccuccagagagguucuguugcugacgguggguuuaucucucgucgcuagcguagaacugccaaauucacuugaggaacugggggauggauuggccaugggcauuaugaugcucaaacugcuaacagacuuccaaccccaccagcuguggaccacucuucucagucugaccuuuauaaggacauccuugucucuggauuaugcauggaagacuauggccauggcuuuaagcaucgugucccucuucccgcugugucuuucaaccacgagccagaaaacaaccuggcugccuguuuugcucggcaguuuugggugcaagccacugacuauguuccuaauuacagagaacaagaucuggggacgaaaaucuuggcccauuaacgaagguaucauggcggugggcauagucuccauccugcuuagcucgcuccugaagaaugacgugccuuuggccgggcccuuaauugcaggaggcaugcugaucgcuuguuacguaauuucagguucuagugccgaucucucccuggagaaagccgcugaggugagcugggaagaggaagcagagcauucugggaccagccacaacauccuugucgaaguucaggacgauggaacuaugaagauaaaagacgaggagcgcgaugacacacugaccauuuugcuaaaggccacgcugcucgcgguguccggcguguauccaaugucaaucccugcuacucuguuugucugguacuucuggcaaaaaaagaagcagcggaguggcgugcuuugggauacccccagcccaccggaaguugagagagccguauuagacgacgggaucuauaggauucugcagcguggacucuugggucgcucucaggugggcgucggggugcugcaagauggaguuuuccauacaauguggcacgugacccggggcgcaguccucauguaccaggguaaaagacuggaaccuuccugggccucagugaagaaagaccuuauaaguuacgggggaggcuggagguuucagggcagcuggaauacaggggaggagguacaggucaucgcuguggaacccggaaagaacccaaaaaauguucaaacuacccccgguacguucaagacaccugagggcgaagugggggcaauugcccuggauuuuaagccaggaacuuccggcucucccaucgucaaccgagaggguaaaauugugggguuguauggaaauggcguugugaccacaucgggcaccuacgucagcgcgaucgcucaggccaaggcaacucaggaagggccucuaccggagauagaggacgaaguguucaaaaagcggaaccugaccaucauggaucuccacccaggaucagguaaaacacgcagauauuuacccgccauuguaagggaggcuaucaagcggaagcugcgaacgcuuauucuggccccuacuagagugguugcauccgaaauggcugaggcccucaaaggcaugccaauccgcuaccaaaccacagcggucaagagugaacauaccgggagggagauaguggacuugaugugccacgccacuuuuacaaugcgucugcucucucccgugcgggucccuaauuauaacaugauuaucauggaugaggcacauuucaccgacccggcuagcaucgccgcuagaggauacauuuccacgaggguaggcaugggugaagcagccgccaucuuuaugacugcuacacccccagggucaguggaggcguucccucagucuaaugcaguuauacaggaugaagagcgcgacauucccgaacgaagcuggaacaguggauaugauuggaucaccgacuuuccaggcaaaaccgugugguucgucccuuccauuaagagcggcaaugacaucgccaacugucugagaaaaaaugggaagcgggugauacagcuuucuaggaagacuuuugauacagaguaccaaaaaaccaagaacaacgacugggauuacguugugacaacugacauuucagagaugggagcuaauuuccgcgccgaucgugucaucgaccccagacggugccuaaaaccagugauccugaaggaagguccggagaggguaauuuuggcaggcccuaugcccgugacgguugccuccgcugcgcagcgccgagggagaaucggacggaaccagaauaaagaaggcgaucaguauauuuacaugggucaaccauuaaacaaugacgaggaucacgcccauuggaccgaggcaaagaugcugcucgacaacauaaauacacccgaagggaucauuccugcucuguucgagccagaaagggagaagagugccgcaaucgauggcgaauaucgccuuagaggagaggccaggaaaacuuuugucgagcugaugcggcguggcgaccuccccgugugguugagcuacaagguggcuucggaaggguuccaguauucugaucgccgauggugcuuugacggagagagaaacaaucagguccuggaagagaacauggacguugaaaucuggaccaaagagggugagaggaagaaacuacggccucgcuggcuggaugccagaacauacuccgacccgcucgcgcuuagggaauucaaggaguuugcagccggccggcgaagcgugucaggggaucugauuuuagaaauaggaaaauugccacagcaccugacccucagagcucaaaaugcccuggacaaccuuguaaugcugcacaauagugagcagggcgguaaggcuuaucgccaugcaauggaagagcuccccgauacuaucgagacguugaugcuguuagcccuaauugcugugcugaccgggggcgucacacucuucuuucuuucuggaaagggccuggggaaaacuuccaucggauugcugugugugauggccagcucagcacuccuguggauggcgaguguugaaccucacuggauugccgcuagcaucauacuugaguucuuucucauggugcuguugauccccgaaccagacaggcagcggaccccucaggauaaccaacuggccuacgucguaauugguuuacuauucaugauccugacaguggcagcuaaugagaugggccuccuugagaccacuaagaaagaccuggggauuggacauguugccguggaaaaccaccaccaugcaacaauguuggaugucgaccugcgucccgccuccgcuuggacgcucuacgcgguggccaccacugucaucacaccaaugaugagacacaccauagagaacaccacagcaaauauuucucugacugcuaucgccaaccaggccgcaauucuuaugggcuuagauaaggguuggccuaucagcaaaauggacauaggggugccgcugcucgcuuugggcugcuauucccagguuaauccccugacgcuaaccgccgcggugcugaugcucguagcucauuacgccaucauuggaccaggccuucaagcaaaggccacaagggaagcucagaagcgcacugcagccgggaucaugaaaaacccuaccguggauggaauugucacaaucgaccuggaccccguuguguaugaugcgaaguuugagaaacaguugggccagauaaugcugcucauucuguguaccucacaaaucuuacuuaugcggacuacgugggcucugugcgaaucuaucacacucgccaccgguccacuaacuacccugugggaggggaguccuggaaaguucuggaauacaacuauugcagucucgauggccaacaucuuucgaggcagcuacuuggcuggugccggccuggcauucucccucaugaaaucucuugggggaggcagaagggggaccggagcucagggcgagacacugggugaaaaguggaagcgccaguugaaucagcugucaaaaagcgaguucaacacguauaagaaauccgggauaauggaaguggaccggagugaggccaaggaaggacucaaaagaggcgagaccacuaagcacgcgguaucucgugguacagccaaguuaaggugguuuguggagcggaaucugguuaaacccgaaggcaaggugauugaucuuggguguggacgcggcggguggagcuacuauugcgcaggacugaaaaaggucaccgaggugaaaggcuacacuaagggugggccgggacaugaagagccaaucccuauggcuacauacggcuggaaccuagucaaacuccacucaggcaaggacguguucuuuacccccccagaaaagugugauacgcuguugugcgacauuggggaguccagucccaauccuaccaucgaggaaggacgaacacugagaguucucaaaaugguagagccguggcuuagggguaaccaauucuguauaaagauccugaaucccuauaugccaagcguggucgaaacuuuagagcagaugcagcggaaacacggcgggaugcuggugcgcaacccuuugucuagaaauuccacccaugagauguacuggguuucaugcggaacaggcaacauugugagcgccgucaauaugacuucgaggaugcuccugaaccgauuuaccauggcacaccggaagcccacauaugaacgugauguggaccuaggugcugggaccagacauguagccguggagccugaaguugccaaccuugauaucauuggacagcgcaucgagaauauuaaaaacgaacacaagucuacuuggcacuacgacgaggauaauccauauaagacgugggcguaccauggcaguuaugaggucaaacccuccggcagcgcuucauccauggugaacgggguggucaggcugcucacaaagccuugggacguuaucccaauggugacccaaauagcaaugacugacaccacacccuucggacagcagcggguauuuaaagaaaagguggauacgagaaccccgcgcgccaaaagggguacugcucaaauuauggaggucacagccaaguggcuguggggcuucuugucucgaaauaagaaaccucggaucuguaccagagaagaguuuacuaggaaggugcgcagcaacgcagccaucggggcuguuuucguggacgaaaaucaguggaacagugcgaaagaggccgucgaggaugaacguuuuugggaccuggugcaccgggagagagaacuccauaagcagggaaaaugcgcaacaugcguauacaauaugaugggcaagagggagaagaaacuuggugaauucgggaaggcuaaaggaucccgcgccauuugguacauguggcugggcgcacgauuuuuagaguucgaggcccugggcuucaugaacgaagaucacugguuuagccgggagaauucuuugucagggguugaaggagagggucuccauaagcugggcuauauacuaagagacaucaguaaaauuccagggggaaacauguacgcugaugacaccgccggcugggauacaaggaucacugaggacgaucuucagaaugaagcgaagauuaccgacaucauggagcccgaacacgcacugcucgccacguccauauucaaacugaccuaucaaaacaaggugguccgcgugcagagaccugcuaagagcgguacagugauggaugucaucucucggagggaccagcgugggucgggacagguuggcacuuacggcuugaauaccuuuacaaacauggaggugcaauuaauucgacagauggaaucagaggggaucuucagcccauccgagcuggaaacucccaaccucgccaaaaagguacuugacuggcuggagaaacacggagcagaacgccuaaagagaauggcuauuaguggugaugacuguguggucaaaccgaucgaugaccgguuugccaccgcucugacggcccucaaugauaugggcaaggugaggaaggacauaccucagugggagcccucuaaaggguggaacgauuggcagcaaguuccauucugcagccaucacuuucaucaguugauuaugaaggacggacgcgaaaucguggucccuuguagaaaucaggaugagcuggugggccgggcaaggguaucccagggugcgggguggucacuucgagagacagccugccugggaaaaaguuaugcucaaauguggcagcucauguacuuccaccguagagacuuacgccuggccgcaaacgcuaucuguucugccguucccguggauugggucccaaccagccggacuacaugguccauucacgcacaucaccaguggaugaccacugaagacauguugucaguguggaauaggguuuggauagaggaaaaccccuggauggaggacaagacccaugugagcucuugggaagaggucccuuaucugggcaaaagagaggaucaauggugcggcucccucaucgggcuuacagcccgcgcgacgugggcuaccaauauucagguggccaucaaccagguacggaggcugauuggaaaugaaaacuaccuagacuacaugacuaguaugaagcgauuuaagaaugagagcgauccagaaggugcacugugguga

SEQ ID NO: 13235 - RNA, 9879 nt, Artificial Sequence
  derived and/or modified CDS sequence (opt3) from DENV-1__FJ850090__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagagguagaaccggacgauguggacuguuggugcaaugccaccgauacuugggucacauaugggaccuguagucaaacgggagagcaccgccgagacaagcguagcguggcgcuggcuccccauguuggcuugggucucgagacuagaaccgaaacauggauguccucugagggggccuggaaacagauccagaagguggaaacuugggcacugaggcacccuggauucaccgucauugcccuguuucucgcucaugcaaucggcacaucgauuacccagaagggcaucauauucaucuuacugaugcuugugacgccaucaauggccaugcggugcguagggauuggaaaccgcgauuuuguugaggguuugagcggcgcuacuuggguggacgucgugcuggagcacgggaguugugugacaaccauggccaaaaauaagcccacucuagauaucgaacuccugaaaacagaggucaccaacccugcgguucuuagaaagcugugcauugaagcaaaaaucuccaauacgaccacagacucuagguguccaacucaaggagaggccaccuugguggaagagcaggaugcuaacuucguaugccggcgcacauuuguggaccgaggcugggguaauggguguggacucuucggcaagggcagccuguuaacuugcgccaaguuuaaaugcgucaccaagcuggaggggaaaauagugcaguacgaaaaccucaaguauuccguuauugugacaguccacaccggagaucagcaucaaguggguaaugagacuacggaacacggcacaaucgcaaccauuacuccccaggcuccuaccucagagauccagcuuacagacuacggggcccugaccuuggacuguaguccaagaacuggacuagauuucaacgaaaugguacugcucacaaugaaagagaagagcuggcugguucauaaacagugguuucuugaccugccguugcccuggacgucuggcgcguccaccucacaagagacuuggaauaggcaggaucuccuggugacauucaagaccgcccacgcaaagaaacaggaagucguggucuuagguagccaagagggggcuaugcacacagcccugacuggcgcuaccgaaauccagacgaguggaaccacaacuauuuuugccggccaucuaaagugccggcucaaaauggacaagcugacccuuaaagggaugucuuaugugauguguacaggauccuucaaguuggagaaggaaguugcagagacucagcacgguaccgugcugguacaggucaaauacgagggcacggaugccccuugcaagauaccauuccucacacaagacgaaaaaggggugauccagaacggacgucugauuaccgcuaaucccaucguuacugauaaggagaaaccugugaacauagaaacagagccacccuuuggcgagagcuauauugucgugggugcgggggaaaaggcacuuaagcugucgugguucaaaaagggcucuuccaucggaaaaauguuugaggccaccgcucgcggcgccagaaggauggcaaucuugggggacacugccugggauuucggaucaauugguggccucuuuaccaguguagggaagcugauccaucagguguucggaacagcuuacggcguuuuauuuagcggugucuccuggacgaugaaaauugggauaggcauccugcuaaccuggcucggacugaauucucggagcacuucacuuaguaugacauguauugccgugggcauggugaccuuguaccugggggucaugguucaggcagacuccggaugcgugaucaacuggaagggccgagaacucaagugugguagcgggaucuucgugacaaacgagguacacacuuggaccgaacaauauaaauuucaggcggauucuccgaagcgccugucagcugccauuggaaaagcaugggaggagggcgucugcgguauaagaagugccacgagguuagaaaauaucauguggaagcagauuagcaacgagcugaauuacauccuuuuggaaaacgacaugaaauucacagugguugugggcgacgcuaaugggauucucacccagggaaagaaaaugauccggccucaacccauggagcauaaguauuccuggaagucuuggggcaaagccaagauaaucggggcagauauucagaacacuaccuuuaucauugacggaccagauacaccugaaugucccgacgaucagcgcgcuuggaauaucugggaggucgaggacuacggcuucgguauauuuacuaccaacauuuggcugaaacuaagagauucgcacacacagaugugcgaccacaggcugaugagcgccgcgaucaaggauuccaaagccgugcaugcugacaugggguauuggauugaaucagagaagaaugaaacguggaagcucgcacgugccaguuucaucgagguuaaaaccuguauauggccaaagucucacacucuguggagcaacggagugcuugaauccgagaugaucauucccaaaaucuacggcgguccuacaucacaacauaauuaucggccaggcuacuucacccagacugcugggccguggcacuugggaaagcuggaguuagauuuugaccucugcgaaggcacaaccguagucguggaugagcacugcggguaccgaggacccagccugagaacgacuaccgugacaggcaaaauuauccaugaaugguguugcaggucuuguacccuuccuccacugcgcuuccggggugaggacgggugcugguauggaauggagauaagacccgucaaggaaaaggaggaaaacuugguuagguccauggugagugccggcagcggugagguagacucuuuuucccucggcauucugugugugucaauccuaaucgaagaggucaugcgcagucgauggagccggaaaaugcugaugacugggacacucgcaguguuccugcuuuugauuaugggacagcugaccuggaaugauuuaauccgucucugcauuaugguuggcgcgaacgccucggacagaauggggaugggaacaacuuaccuggcucuuauggccaccuuuaagaugaggccuauguucgcagugggccugcuauuucgcaaacucacgucccgggagguccuguugcugacaauagguuuaucucucguggcuagcguugaacugccaaauucacuugaggaacugggggauggauuggccaugggcaucaugaugcucaagcugcuaaccgacuuccaaccccaccagcuguggacuacccuucucagucugacauuuauuagaacuuccuugucucuggauuaugcauggaaaaccauggccauggcuuuaagcaucgugucccucuucccgcugugucuuucaacgacaagccagaagaccacuuggcugccugucuugcucggcaguuuugggugcaagccacugacaauguuccuaauuaccgagaacaaaaucuggggaaggaagucuuggcccauaaacgaagguaucauggcgguaggcauuguguccauccugcuuagcucgcuccugaaaaaugacguuccuuuggccgggcccuuaauugcaggaggcaugcugaucgcuuguuacgugauaucagguucuagugccgaucucucccuggagaaggccgcugaggucagcugggaagaggaagcagagcauucugggacuagccacaacauucuuguggaaguacaggacgauggaacaaugaaaaucaaggacgaggagcgagaugacacccugacgaucuugcuaaaagccacucugcucgcgguguccggcgucuauccaaugucaauuccugcuacccuguuuguuugguacuucuggcaaaagaagaaacagcgcaguggcgugcuuugggauacacccagcccaccggaaguggagcgggccgucuuagacgacgggauauauagaauccugcagaggggacucuugggucguucucaggugggcguugggguauuccaagauggaguguuucauaccauguggcacgucacacgcggcgcagugcugauguaccaggguaagcggcucgaaccuuccugggccucaguuaaaaaggaccugauuaguuacgggggaggcuggagauuccagggcagcuggaauacuggggaggaggugcaggucaucgcuguggaacccggaaaaaacccaaagaauguacaaaccacgcccgguacauuuaagacuccugagggcgaagucggggcaauugcccuugauuucaaaccaggaaccuccggcucucccaucgugaacagggaggguaagauaguugggcuguauggaaauggcguggucacaaccucgggcacuuacgugagcgcgaucgcucaggccaaagcaucacaggaagggccuuugccggagauugaggacgaaguuuuuaagaaacgaaaccuaaccaucauggaucugcacccaggauccgguaagacacggcgcuaucuccccgccauugugagagaggcuaucaagaggaaauuacggacgcugauacuugccccuacucgagucguggcaagugaaauggcugaggcccugaagggcaugccaauuagauaccaaaccacagcgguaaaaucugaacauaccgggcgcgagaucguggaccucaugugccacgccacuuucacaaugagguugcugagccccguucgugucccuaauuauaacaugaucauuauggaugaggcacauuuuaccgacccggcuuccaucgccgcucggggauacauaucaacgagagugggcaugggugaagcagccgccauuuucaugacugcuacacccccagggucuguggaggcguuuccucagagcaaugcagucauccaggaugaagagagggacauucccgaacgcaguuggaacuccggauaugauuggaucaccgacuucccaggcaagaccguaugguuugugccuagcauaaaaucuggcaaugacauugccaacugucuccgaaagaaugggaagagaguuauccagcugucacggaaaacuuucgauacagaguaccaaaagaccaaaaacaacgacugggauuacguggucacaacugacaucuccgagaugggagcuaauuucagggccgaucgcgugauugacccccguagaugccuuaagccaguuauccuaaaagaugguccggaacgggugauucuggcaggcccuaugcccgucacgguggccagugcugcgcagaggcgcgggcgaauaggaagaaaccagaauaaggagggcgaccaguauaucuacaugggucaaccauugaacaaugaugaagaccacgcccauuggaccgaggcaaagauguuacuggauaacauuaauacacccgaggggaucaucccugcucucuuugaaccagagcgggaaaaaagcgccgcaauugacggcgaguauaggcugcgcggagaagccagaaagacuuucguagagcuuaugaggcggggcgaucugcccguguggcucucguacaaaguugcuucugagggguuucaguauuccgaccgucgcuggugcuucgacggagaacgaaacaaucaggucuuggaggaaaacauggauguggagauauggaccaaggaaggugagagaaaaaagcugaggccucgguggcuagacgcccgcacauacagcgauccgcuggcgcucagagaguuuaaagaauucgcagccggcaggcggucagugaguggggaccuuauccuggagauuggaaaguuaccacagcacuugacccugcgagcucaaaaugcccucgauaaccuggucaugcuucacaauucugaacagggcgguaaggcuuauagacaugcaauggaggaacugcccgacacuaucgagacgcucauguugcuggccuuaauugcuguucuaaccgggggcgugacacuguuuuuccucuccggaaaaggccuugggaagacuagcaucggacuguuguguguaauggccucaagugcacugcucuggauggcgagcguggagccucacuggauagccgcuuccaucauucuggaauuuuuccuuaugguccuccugauccccgagccagaucgccagaggaccccucaggacaaccaauuggccuacgugguuauuggucuguuauuuaugauccuaacaguggcagcuaaugaaaugggccugcucgagaccacuaaaaaggaucuugggauaggacaugucgccgcagagaaccaccaccaugccacaaugcuggacguagauuugcggcccgcuucugcguggacgcuguacgccguggcaaccacuguuauuacaccaaugaugcgucacaccaucgaaaacaccacagcuaauauuagccucacugccaucgccaaccaggcagcuauacugaugggccuugacaaagguuggccuaucuccaagauggauauuggggugccguuacuggcccucggcugcuauucacaggucaaucccuugacgcugaccgcgacagugcuaaugcuggucgcucauuacgccaucauuggaccaggccuccaagcaaaggccacuagagaggcucagaaaaggaccgcagccgggaucaugaagaacccuacaguggacggaauaguuaccauugaccuugaucccgugguauaugacgcgaaauucgaaaagcagcugggccagaucauguugcugauccucuguacuucucaaauucuguuaaugcgcacgacaugggcucuuugcgagaguaucacccuggccacugguccacucaccacacuaugggaagggucgccuggaaaauuuuggaauacuaccauagcagugagcauggccaacauuuuccggggcuccuaccuggcuggugccggcuuggcauucucucugaugaagucacucgggggaggccgaagagggacaggagcucagggcgagacgcuuggugagaaguggaaaaggcagcugaaucaguugagcaaguccgaauuuaacaccuauaaaaagagugggaucauggaggucgaucgcucugaagccaaagagggacugaagcggggcgaaacuacaaagcacgcgguuagcagagguaccgccaaacuccguugguucguggagaggaauuuagucaagcccgagggcaaagugauugaccugggguguggacggggcggguggucauacuauugcgcaggacuuaagaaaguaacugaagugaagggcuacacaaaaggugggccgggacaugaggaaccaaucccuauggcuaccuacggcuggaaccugguuaagcuacacuccggcaaggauguguuuuucacgcccccagagaaaugugacacccuccugugcgauauaggggaaaguagccccaauccuacaaucgaggagggacgcacuuugcgaguccugaagaugguggaaccguggcucagagguaaccaauuuuguauuaaaauccuuaaucccuauaugccaucugucguggagacccuggaacagaugcagaggaagcacggcgggauguuaguucggaacccucugucccgcaauucaacacaugagauguacuggguaagcugcggaacuggcaacauugugucggccgucaauaugaccucuagaauguugcucaacagguucacaauggcacaccgaaaacccaccuaugagcgggacguggaucugggugcugggacucgucauguugccguggaaccugaggucgccaaccuagacaucauuggacagagaaucgaaaauauaaagaacgagcacaagaguacguggcacuacgaugaagacaauccauauaaaacaugggcguaccauggcuccuaugaggugaagcccagcggcucagcuuccucuaugguaaacggggugguucgccuucugaccaaaccuugggacgucauuccaauggugacucaaaucgcaaugaccgauacaacgcccuuuggacagcagaggguguucaaggagaaagucgacacccggacuccgagagccaagcgcgguacagcucaaaucauggaaguuaccgccaaguggcucugggauuuucugagcaggaauaaaaagccucgaauuuguacucgggaggaauucacaagaaaagugaggaguaacgcagccauaggcgcuguauuuguggacgagaaucaguggaacuccgcgaaggaagccgucgaggaugagcgcuucugggacuuggugcaccgugaacgggagcugcauaaacaggggaagugcgcaaccugcguuuacaauaugaugggaaagagagaaaaaaagcucggcgaguuugguaaagcuaaggggagcagggccaucugguacauguggcuuggagcacgcuuccuggaauucgaggccuuaggcuuuaugaacgaggaucacugguucucucgagaaaauucacugaguggcguggagggggaaggauugcauaaacucgguuauauucugcgggacaucuccaagauuccaggcgggaacauguacgcugaugacacagccggaugggauacuagaaucaccgaggacgaucuacagaaugaggcgaaaauaacggacaucauggaacccgagcacgcacuucuggccaccagcauuuuuaagcucacauaucaaaacaaggucgugaggguacagcgcccugcuaaaucuggcacuguuauggacgugaucucgagacgggaucagagggguucagggcaggucggaaccuacggccugaauacauucacuaacauggaagugcaauugauucgucagauggagagcgaaggcaucuuuuccccaagugaguuagagacccccaaccuggccaagcgagugcucgacuggcuugaaaaacacggggcagagcgccugaagagaauggcuauaucuggagaugacugugucguuaaaccgauugaugaccgguucgccacggcucuaacagcccugaaugauauggguaaggugaggaaggacaucccucagugggaacccagcaaaggcuggaacgauuggcagcaaguaccauuuugcucccaucacuuccaucagcucaucaugaaggacgggcgcgauauuguggucccuuguagaaaucaggacgaguuggugggacgggcaaggguuucacagggcgcggguuggagucugcgagaaaccgccugccuugggaaaucuuaugcucaaauguggcagcugauguacuuucaccguagagaccuccgcuuagccgcaaacgcuauauguagcgccgugcccgucgauugggugccaacuucccggacaaccuggucaauccacgcacaucaccaguggaugacuaccgaggacaugcugagcguauggaauaggguuuggauugaggaaaaccccuggauggaggauaagacacaugugucuuccugggaagaggucccuuauuugggaaaaagagaagaccaauggugcggcagucugaucggccucacggcccgcgcgaccugggcuacuaauauucagguggccaucaaccagguucggaggcuuauagggaaugagaacuaccuggauuacaugacaagcaugaagcgauucaagaaugagucggacccagaaggagcacuaugguga

SEQ ID NO: 13236 - RNA, 9879 nt, Artificial Sequence
  derived and/or modified CDS sequence (opt3) from DENV-1__FJ850093__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacucaccuggcuuuaauggccaccuuuaaaaugcgcccuauguucgcagugggucuccuguuucggagacuuacgucuagggagguccugcuacucacaaucgggcugagcuugauggccucaauggaacugccaaacaguuuagaggaacucggagacggccuggcuaugggcauuaugaugcuuaagcuguugaccgaguuccaaccccaucagcucuggacuacccugcuaucccugacauuugugaaaacuacccuuucucucgauuaugcguggaagacgacagccaugauacugagcaucguuuccuuguucccgcuguguuuaucaaccacuagccagaaaacaaccuggcucccugugcugcuugggaguuuuggaugcaagccacugacuauguucuugauuacagaaaacaagaucuggggucgaaaaucuuggccccucaaugagggcauuauggcaaucgggauagucuccauccugcuaagcucgcugcuuaagaacgacguaccucucgcuggaccccugauugccggcgguauguugaucgccuguuacgugauuucagggucuagugcugauuuaucccuggagaaagcagccgaaguuagcugggagcaggaagcggagcacucuggagcuagccauaauauccucguggaaguccaagacgauggcaccaugaagauaaaagacgaggagcgcgaugacacgcugacuauucuucugaaggccaccuugcuagcaguguccggcguauauccaaugucaaucccugccacacuguuugugugguacuucuggcagaaaaagaagcagcggagugggguccucugggauacccccagcccaccggaaguugagagagcugugcuggacgauggaaucuauaggauucuucagcgugguuuacugggccgcucucaagugggggucggaguguuccaggacggcguuuuucacacaauguggcacguaacucggggugcagugcucauguaccaggggaaaagauuggaaccuuccugggccucagucaagaaagaccugauaaguuauggaggcggcuggagguuccaggggagcuggaacaccggagaggaggugcaaguuaucgcgguggaacccgguaagaauccaaaaaacguccagacgacacccggcacuuuuaagaccccugagggggaagugggagcuauugcccucgauuucaagccaggcacauccgguucucccaucguaaaucgagaggggaaaauugucggacuguacggcaacggcgugguuaccacuucggggaccuacgugagcgcaaucgcccaggcuaaggccucacaagaaggaccucuuccggagauagaggacgaagucuuuaaaaagcggaaucugacaaucauggauuugcauccagguuccggcaaaacgcgcagauaucuacccgcaauugugagggaggcuaucaagcggaagcugcgaacucucauuuuagccccuaccagaguuguggcgagugaaauggccgaggcacugaaagggaugccaauccgcuaccagacaaccgcugucaagucugaaacuacaggaagggagauaguggaccuuaugugccacgccaccuucacgaugcgucugcucagccccguacgggugccuaacuauaauaugauuaucauggaugaggcucauuuuacugacccggcauccaucgccgccagaggcuacauuucaacaaggguugguaugggggaagcugcggcaaucuucaugaccgccacccccccaggaucugucgaggcuuuuccucagagcaacgccgugauacaggaugaagagcgcgacauucccgaacgaaguuggaauuccggcuaugauuggaucacugacuucccaggcaaaacagugugguuugucccuagcauuaagucugggaacgauaucgcaaauuguuugagaaaaaacggaaagcggguaauacaacugucaaggaagaccuucgacacagaguaccagaaaacuaagaacaaugacugggauuaugugguuacgaccgacauuuccgagaugggugccaacuuccgcgcugaucgugugaucgaccccagacggugccucaaaccagucauccugaaggauggcccggaaagggugauucuugcggggccuaugcccguuacaguggccagugcagcucagcgccgaggaagaaucggccggaaucagaacaaagagggugaccaauacgucuacauggggcagccacuaaauaacgaugaagaccacgcccauuggacugaggcaaagaugcuguuggauaauauuaacacccccgagggcauaaucccugccuuauuugaaccagagagggaaaagagcgcugccauugacggagaguaucgccugagaggcgaagcgaggaaaacauucguggagcucaugcggcguggggaucugcccguauggcuuucguacaagguggcaucugagggauuucaguauuccgaccgccgauggugcuucgauggugaaagaaauaaccagguucuggaggaaaauauggacgucgagaucuggaccaaagaaggcgagaggaagaaacuccggccucgcugguuggacgccagaacuuacagcgauccgcuggcucuaagggaguuuaaggaauucgccgcugggcggcgaucagugaguggagaccugauccucgagauuggcaaacuuccacaacaccugacguuaagagcacagaacgccuuggauaaucuggugaugcuccacaacucugaacagggugggaaggcuuaucgccaugccauggaggaacugcccgacaccauagagacacuuaugcugcucgcauugaucgcgguccugacuggcggaguuaccuuauuuuuccuauccggcaaggggcugggaaaaacaagcauuggucuccuuugugugaccgccucaagugcucuguuguggauggccagcguagagccucacuggaucgcagcuuccauuauccuggaauuuuuccucauggugcugcuuauacccgagccagauaggcagcggacuccucaagacaaucagcucgccuacgucgugaucggccuguuguuuaugauucugacaguugcagccaacgaaaugggguuacuagagacgaccaagaaagaucugggaaucggcuauguggcugcggagaaccaucagcacgccacuaugcucgacgucgaucuucgucccgcaucugcuuggacacuguacgccguagccaccaccgugauuacaccaaugaugagacacacuaucgaaaauacgaccgcaaacauaagcuugacagcuauugccaaucaagcggcuauccugaugggucucgacaagggguggccuauuuccaaaauggauaucggcguuccgcugcuugccuuaggaugcuacucacaggugaacccccugacucucaccgcagccgucuugaugcugguggcucauuaugcaauaaucggcccagggcuacaggccaaggcgacaagggaggcucagaagcgcaccgccgcaggaauuaugaaaaauccuacugucgacggcaucguggccauugaucuggaccccguuguguacgacgcuaaguucgaaaaacaacucggucagaucaugcuucugauauuguguacgucucagauucugcucaugcggacaaccugggcccugugcgagaguaucacuuuagcaaccgggccacuuacaacucugugggaaggaucgccuggcaaguuuuggaacaccacaaucgcuguaagcauggccaauauuuuccgagguuccuaucucgcgggcgccgggcuagcauucucucugaugaaaucauugggaggcgggagaaggggaacgggcgcucagggugagacccugggggagaaguggaagcgccaacucaaccagcuuagcaaauccgaauuuaauacuuacaagcggaguggaaucauggagguggauagaucugaagccaaagagggccugaagcguggugaaacaaccaaacacgcagucagcaggggcacugcuaaguugcggugguucguugagcgcaaccuggugaagcccgaggggaaagucauagaccucggauguggccgagggggauggucauauuacugcgccggcuuaaagagagugacagaaguaaaagguuauaccaaggggggaccgggccaugaggaaccaauuccuauggccacguacggcuggaaucuggugaaacuucacuccgggaaggauguuuuuuucaugcccccagagaaaugugacacccugcuaugcgauaucggagaaaguagccccaacccuacaauugaggaggguaggacucuccgggugcugaagauggucgaaccgugguugaagggcaaucaguuuuguaucaaaauacugaaccccuacaugccaucuguggucgagacccucgaacagaugcaacgcaagcaugggggaaugcuugugagaaauccucuguccaggaacucaacacacgagauguauuggguuagcugcggcacugguaauaucguaucggcggugaacaugaccucucgaauguuacugaaccgguucacaauggcucaccguaaacccaccuacgagagagacgucgauuugggggcaggaacucgccauguggccguugaaccugagguggcuaaucucgacauuaucggccagaggauugaaaacaucaagaaugagcacaaaaguacguggcauuaugaugaagacaacccauacaagacaugggccuaucacggcuccuacgaggucaagcccagcgggucagcauccucuauggugaauggaguagugcggcugcuaaccaaaccuugggauguuauuccaauggucacucagaucgccaugaccgacacaacgcccuuuggucaacagagaguguucaaggagaaaguggacacccgcacuccgagggcuaagcgaggcacaacccagauaauggaagucacugcgaaauggcuuuggggguuucugagccggaacaagaagccuagaauuuguacaagggaggaauucacccgcaaaguucguaguaaugccgcaaucggagcuguguuuguagaugagaaccaguggaauuccgccaaggaagcaguggaggacgagcgguucugggaucucguccacagagaaagggagcugcauaaacaaggcaagugcgccacaugcguguauaacaugauggguaaacgcgaaaagaaguugggggaguuuggaaaagcuaagggcagccgagccaucugguacauguggcugggcgcgcgguuccucgaauucgaggcacuuggguuuaugaaugaggaccacugguucucuagagaaaacucacugaguggaguugagggugaaggcuuacauaaacugggguacauuuugagggauauauccaagaucccaggaggcaauauguaugccgacgauacugcugguugggacacccgcauuacggaggaugaccuccagaacgaggccaaaaucaccgauauuauggaacccgagcacgcacugcuagcuacaagcaucuuuaagcuuacuuaccagaauaaaguggucagagugcagcggccugccaagaacgggaccguaauggacguuauaucuaggcgugaucaacgaggaucgggccaggugggcacauaugggcugaacacuuucaccaauauggaaguccagcucauccgccagauggagucagaaggaauuuuucugccaagcgaguuggagacgcccaacuuagcugaaagagugcuggacuggcucgagaagcauggugccgaacggcuuaaaaggauggcaaucuccggcgacgauuguguggucaagccgauugacgaucgcuucgcgacagcccugaccgcucuaaaugacauggggaaaguuagaaaggauaucccucaaugggagcccaguaaaggauggaacgacuggcagcaggugccauuuugcucucaccacuuccaucagcugauaaugaaggauggccgggaaauuguagugccuuguaggaaucaagacgagcucgucggucgagcccgugugagccagggggcaggaugguccuugagagagacugcuugccugggcaagucauacgcccagauguggcaacuuauguauuuucaccgccgggaucugaggcucgcagccaacgcgaucuguagugcuguucccguggacugggucccaacaucuagaaccacuuggagcauccaugcccaccaccaguggaugaccacagaagauauguuauccguguggaaucgcguauggauugaggaaaaccccuggauggaggacaaaacgcauguuucaagcugggaagaggugccuuaccugggcaagcgggaggaccaguggugcgggucuuugauaggacugaccgcaagggccacuugggcuacaaauauccaggucgccauuaaccaagugcgaagacucaucgguaaugaaaacuaucuugauuacaugaccuccaugaaacgguucaagaaugagagugacccagaaggcgcacugugguga

SEQ ID NO: 13237 - RNA, 9879 nt, Artificial Sequence
  derived and/or modified CDS sequence (opt3) from DENV-1__GU131863__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacaucaaugggauucucgcccagggaaagaaaaugauccggccucaacccauggagcauaaguauuccuggaagucuuggggcaaagcaaagauaaucggggcugauauucagaacacuaccuuuaucauugacggaccagauacaccugaaugucccgacgaucagcgcgccuggaauaucugggagguggaggacuacggcuucgguauauuuacuaccaacauuuggcugaaacuaagagauucgcacacacagaugugcgaccacaggcugaugagcgcggccaucaaggauuccaaagcuguccaugcagacaugggguauuggauugaaucagagaagaaugaaacguggaagcucgcccgugcuaguuucaucgaggugaaaaccuguauauggccaaagucucacacucuguggagcaacggaguucuugaauccgagauggugauccccaaaauuuacggcgguccuaucucacaacauaauuaucggccaggcuacuucacacagaccgccgggccguggcacuugggaaagcuggaguuagauuuugaccucugcgaaggcacuacaguagucguggaugagcacugcggguaccgaggacccagccugagaaccacgacugugaccggcaaaauuauccaugaaugguguugcaggucuuguacacuuccuccacugcgcuuccggggugaggacgggugcugguauggaauggagauaagacccgucaaggaaaaggaggaaaacuugguuagguccauggugagugcaggcagcggugagguagacucuuuuucccucggcauucugugugugucaauccuaaucgaagaggucaugcgcagucgauggagccggaaaaugcugaugaccgggacucucgcgguguuccugcuuuugauuaugggacagcugacauggaaugauuuaauccgucucugcauuaugguuggcgccaacgcuucggacagaauggggaugggaaccacauaccuggcccuuauggcaacuuuuaagaugaggccuauguucgcugugggccugcuauuucgccggcucaccuccagagagguccuguugcugacgguggguuuaucucucguugccagcguggaacugccaaauucacuugaggaacugggggauggauuggcaaugggcauaaugaugcucaaacugcuaacagacuuccaaccccaccagcuguggaccacucuucucagucugaccuuuaucaggacauccuugucucuggauuaugccuggaagacuauggcuauggcguuaagcauugucucccucuucccgcugugucuuucaaccacgagccagaaaacaaccuggcugccuguauugcucggcaguuuugggugcaagccacugacuauguuccuaaucacagagaacaagauuuggggacgaaaaucuuggcccaucaacgaagguauaauggccgugggcaucguuuccauucugcuuagcucgcuccugaagaaugacgugccuuuggcagggcccuuaaucgcuggaggcaugcugauugccuguuacgucaucucagguucuagugccgaucucucccuggagaaagcugcagaggugagcugggaagaggaagccgagcauucugggaccagccacaacauacuuguagaagugcaggacgauggaacuaugaagauuaaagacgaggagcgcgaugacacacugaccaucuugcuaaaggcgacgcugcucgcugucuccggcguuuauccaaugucaaucccugccacucuguuugugugguacuucuggcaaaaaaagaagcagcggaguggcgugcuuugggauacccccagcccaccggaagucgagagagcaguguuagacgacgggauuuauaggauacugcagcguggacucuugggucgcucucagguuggcguagggguguuccaagauggagucuuucauacaauguggcacgugacccggggcgccguucugauguaccaggguaaaagacucgaaccuuccugggcuucagugaagaaagaccugaucaguuacgggggaggcuggagguuccagggcagcuggaauacaggggaggagguccaggugauugcaguagaacccggaaagaacccaaaaaauguccaaacuacccccgguacguuuaagacaccugagggcgaagugggggccaucgcgcuugauuucaagccaggaacuuccggcucucccauuguuaaccgagaggguaaaaucguggggcuguauggaaauggcgucgugaccacaucgggcaccuacguuagcgcuauagcccaggcaaaggccacucaggaagggccuuugccggagaucgaggacgaaguguuuaaaaagcggaaccuaaccauuauggaucugcacccaggaucagguaaaacacgcagauaucuccccgcuaucgucagggaggccauuaagcggaaguuacgaacgcugauccuugcaccuacuagagugguagcuuccgaaauggccgaggcgcugaaaggcaugccaauacgcuaccaaaccacagccgugaagagugaacauaccgggagggagauuguugaccucaugugccacgcaacuuucacaaugcguuugcugucucccguccgggugccuaauuauaacaugaucaucauggaugaggcucauuuuaccgacccggccagcauugcugcaagaggauacaucuccacgagggugggcaugggugaagccgccgcuauauucaugacugcgacacccccagggucagucgaggcauuuccucagucuaaugccguaauucaggaugaagagcgcgacauccccgaacgaagcuggaacaguggauaugauuggauuaccgacuucccaggcaaaaccgugugguuuguuccuuccaucaagagcggcaaugacauagcuaacugucucagaaaaaaugggaagcgggugauucagcugucuaggaagacuuucgauacagaguaccaaaaaaccaagaacaacgacugggauuacgucgugacaacugacaucucagagaugggagccaauuuccgcgcagaucguguuaucgaccccagacggugccuuaaaccagugauucuaaaggaagguccggagagggucauccuggccggcccuaugcccgugacgguagcuuccgcggcccagcgccgagggagaauuggacggaaccagaauaaagaaggcgaucaguauauauacaugggucaaccauugaacaaugacgaggaucacgcacauuggaccgaggcuaagauguuacuggacaacaucaauacacccgaagggauuaucccugcccucuuugagccagaaagggagaagagugcagccaucgauggcgaauaucgccugagaggagaggcuaggaaaacuuucguggagcuuaugcggcguggcgaccugcccguuuggcucagcuacaaggucgccucggaaggguuucaguauucugaucgccgauggugcuucgacggagagagaaacaaucagguguuggaagagaacauggacguggaaauuuggaccaaagagggugagaggaagaaacugcggccucgcuggcuagaugcgagaacauacuccgacccgcuggcacucagggaauuuaaggaguucgccgcuggccggcgaagcgucucaggggaucuuauacuggaaaucggaaaauuaccacagcacuugacccugagagcccaaaaugcucucgacaaccugguuaugcuucacaauagugagcagggcgguaaggcauaucgccaugccauggaagagcugcccgauacuauugagacgcucauguugcuggcuuuaaucgccgugcuaaccgggggcguaacacuguuuuuccucucuggaaagggccuugggaaaacuuccauuggacuguugugugugauggcaagcucagcgcugcucuggauggccagugucgaaccucacuggaucgcugccagcauaauccuggaguuuuuccuuauggugcuccugauucccgaaccagacaggcagcggaccccucaggauaaccaauuggcauacguugugaucggucuguuauuuaugauucuaacagucgcugccaaugagaugggccugcucgagaccacuaagaaagaccuugggaucggacauguagcaguggaaaaccaccaccaugccacaaugcuggauguugacuugcgucccgcuuccgcguggacgcuguacgccguggcaaccacugucauaacaccaaugaugagacacaccauugagaacaccacagcuaauaucucucucacugccauugccaaccaggcagcuauccugaugggccuugauaaggguuggccuauaagcaaaauggacaucggggugccguuacuggcccucggcugcuauucccaggucaaucccuugacgcugaccgcggcugugcuaaugcugguugcccauuacgcaauuaucggaccaggccuccaagccaaggcuacaagggaagcacagaagcgcacugccgcggggauuaugaaaaacccuaccguggauggaaucguaacaauagaccuugaccccguggucuaugaugcuaaguucgagaaacagcugggccagauuauguugcugauccucuguaccucacaaauccuguuaaugcggacuacgugggcccuuugcgaaucuauuacacuggcaaccgguccacucacuacccuaugggaggggaguccuggaaaguuuuggaauacaacuaucgccguuucgauggcuaacauauuccgaggcagcuaccuggccggugcaggcuuggcuuucucccugaugaaaucucucgggggaggcagaagggggaccggagcccagggcgagacacuuggugaaaaguggaagcgccagcugaaucaguugucaaaaagcgaguuuaacacguauaagaaauccgggauuauggaaguggaccggagugaggcgaaggaaggacugaaaagaggcgagaccacuaagcacgccgucucucgugguacagcaaagcucaggugguucguggagcggaauuuaguaaaacccgaaggcaaggugaucgaucugggguguggacgcggcggguggagcuacuauugcgcuggacuuaaaaagguuaccgaggugaaaggcuacacuaagggugggccgggacaugaagagccaauuccuauggccacauacggcuggaaccuggucaaacuacacucaggcaaggacguguuuuucacccccccagaaaagugugauacgcuccugugcgacaucggggaguccagucccaauccuaccauagaggaaggacgaacauugagaguccugaaaaugguggagccguggcucagggguaaccaauuuuguaucaagauucuuaaucccuauaugccaagcguuguagaaacucuggagcagaugcagcggaaacacggcgggauguuagugcgcaacccucugucuagaaauuccacccaugagauguacugggucucaugcggaacaggcaacaucgugagcgcaguuaauaugacuucgaggauguugcucaaccgauucaccauggcucaccggaagcccacauaugaacgugauguggaccugggugccgggaccagacaugucgccguggagccugaaguagcgaaccuagauauuaucggacagcgcauugagaauaucaaaaacgaacacaagucuacuuggcacuacgacgaggauaauccauauaagacgugggcuuaccauggcaguuaugaggugaaacccuccggcagcgcaucauccaugguuaacggggucgugaggcuucugacaaagccuugggacgugauaccaauggucacccaaauugccaugacugacaccacacccuuuggacagcagcggguuuucaaagaaaagguggauacgagaaccccgcgcgcuaaaagggguacugcccaaaucauggagguaacagcaaaguggcucuggggcuuucugucucgaaauaagaaaccucggaucuguaccagagaagaguucacuaggaaggugcgcagcaacgccgcuauuggggcggucuuuguggacgaaaaucaguggaacagugccaaagaggcaguugaggaugaacguuucugggacuuggugcaccgggagagagaacugcauaagcagggaaaaugcgcuacaugcgucuacaauaugaugggcaagagggagaagaaacucggugaauuugggaaggccaaaggaucccgcgcaauaugguacauguggcuuggcgcccgauuccuggaguucgaggcuuuaggcuuuaugaacgaagaucacugguucagccgggagaauucucugucagggguggaaggagaggguuugcauaagcucggcuauauccugagagacauuaguaaaaucccagggggaaacauguacgccgaugacaccgcgggcugggauacaaggauuacugaggacgaucuacagaaugaagcaaagaucaccgacauaauggagcccgaacacgcccuucuggcuacguccaucuuuaaacucaccuaucaaaacaagguaguucgcgugcagagaccugccaagagcgguacagucauggaugugauuucucggagggaccagcgugggucgggacaggugggcacuuacggccugaauaccuucacaaacauggagguccaauugauccgacagauggaaucagaggggauuuuuagcccauccgaguuagaaacucccaaccuggcaaaaaagguucucgacuggcuugagaaacacggagcugaacgccugaagagaauggccaucaguggugaugacugugugguaaaaccgauagaugaccgguucgcuaccgcccuaacggcacugaaugauaugggcaaggugaggaaggacauuccucagugggagcccucuaaaggguggaacgauuggcagcaagucccauuuugcagccaucacuuccaucagcucaucaugaaggacggacgcgaaaucgugguuccuuguagaaaucaggaugaguuggugggccgggcgagggucucccagggugccggguggucacugcgagagacagcuugccuuggaaaaaguuaugcccaaauguggcagcugauguacuuucaccguagagaccuccgcuuagcagcuaacgccauuuguucugcagugcccguagauuggguuccaaccagccggacuacaugguccauacacgcccaucaccaguggaugaccacugaagacaugcugucaguguggaauagggucuggaucgaggaaaaccccuggauggaggacaagacccaugugagcucuugggaagagguuccuuauuugggcaaaagagaggaucaauggugcggcucccugauugggcucacagcgcgcgcuacgugggccaccaauauccagguggcaauuaaccagguccggaggcuuaucggaaaugaaaacuaccuggacuacaugacuaguaugaagcgauucaagaaugagagcgauccagaaggugcccuaugguga

SEQ ID NO: 13238 - RNA, 9879 nt, Artificial Sequence
  derived and/or modified CDS sequence (opt3) from DENV-1__GQ868559__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucauacaauguggcacgugacucggggugcaguucucauguaucaggggaaaagauuggaaccuuccugggccucagugaagaaagaccugauuaguuacggaggcggcuggagguuccaggggagcuggaacaccggagaggagguccaagugauagcgguagaacccgguaagaauccaaaaaacguccagacgacacccggcacuuuuaagaccccugagggggaagugggagcuaucgcccucgauuucaagccaggcacauccgguucucccauuguuaaucgagaggggaaaaucgugggacuguacggcaacggcgucgugaccacuucggggaccuauguuagcgcaauugcccaggcuaaggccucacaagaaggaccucuuccggagaucgaggacgaaguguuuaaaaagcggaaucugacaauaauggauuugcacccagguuccggcaaaacgcgcagauaccuacccgcaaucgucagggaggcuauuaagcggaagcugcgaacucucaucuuagccccuaccagagugguagcgagugaaauggccgaggcacugaaagggaugccaauucgcuaucagacaaccgcugugaagucugaacauacuggaagggagaucguugaccuuaugugccacgccacauucaccaugcgucugcucagccccguccgggugccuaacuacaauaugauaauuauggaugaggcucauuuuacggacccggcauccaucgccgccagaggcuauaucucaacuaggguggguaugggggaagcugcggcaauuuucaugacagccacccccccaggaucugucgaggcuuuuccucagagcaacgccguaauccaggaugaagagcgcgacauacccgaacgaaguuggaauuccggcuacgauuggauuaccgacuucccaggcaaaacugugugguuuguuccuagcaucaagucugggaacgauauugcaaauuguuugagaaaaaacggaaagcgggugauccaacugucaaggaagacauucgacaccgaguaucagaaaacaaagaacaaugacugggauuacgucgugacuacggacauauccgagaugggugccaacuuccgcgcugaucguguuauugaccccagacggugccucaaaccagugauccugaaggauggcccggaaagggucauccuugcggggccuaugcccgugaccguagccagugcagcucagcgccgaggaagaauuggccggaaucagaacaaagagggugaccaauacguguauauggggcagccacuaaauaacgaugaagaccacgcccauuggacagaggcaaagaugcuguuggauaauaucaacacucccgagggcauuauaccugccuuauuugaaccagagagggaaaagagcgcugccaucgacggagaguaccgccugagaggcgaagcgaggaaaaccuucguugagcucaugcggcguggggaucugcccgucuggcuuucguauaagguggcaucugagggauuucaguacuccgaccgccgauggugcuucgauggugaaagaaauaaccaggugcuggaggaaaauauggacgucgagauuuggacaaaagaaggcgagaggaagaaacuccggccucgcugguuggacgccagaaccuauagcgauccgcuggcucuaagggaguuuaaggaauucgccgcugggcggcgaucaguuaguggagaccugauccucgagaucggcaaacuuccacaacaccugacuuuaagagcacagaacgccuuggauaaucuggugaugcuccacaacucugaacagggugggaaggcuuaccgccaugccauggaggaacugcccgacacgauugagacccuuaugcugcucgcauugauagcgguacugacaggcggagugacuuuauuuuuccuauccggcaaggggcugggaaaaaccagcaucggucuccuuugugucacagccucaagugcucuguuguggauggccagcguggagccucacuggauugcagcuuccaucauucuggaauuuuuccucaugguucugcuuauccccgagccagauaggcagcggaccccucaagacaaucagcucgccuauguggucauaggccuguuguuuaugauccugacuguagcagccaacgaaaugggguuacuagagacaacgaagaaagaucugggaauuggcuacguggcugcggagaaccaucagcacgccaccaugcucgacguugaucuucgucccgcaucugcuuggacucuguacgccguggccacaaccgucaucaccccaaugaugagacacacaauugaaaauacuacggcaaacaucagcuugaccgcuauagccaaucaagcggcuauucugaugggucucgacaagggguggccuaucuccaaaauggauauuggcgugccgcugcuugccuuaggaugcuauucacaggucaacccccugacacucacugcagccguguugaugcugguugcucauuacgcaaucauaggcccagggcuacaggccaaggcgaccagggaggcucagaagcgcacagccgcaggaaucaugaaaaauccuaccguggacggcauuguagccaucgaucuggaccccguggucuaugacgcuaaguucgaaaaacaacucggucagauuaugcuucugaucuuguguacuucucagauacugcucaugcggacgacaugggcccugugcgagaguauuaccuuagcaacugggccacuuaccacacugugggaaggaucgccuggcaaguuuuggaacacuaccaucgcuguuagcauggccaauaucuuccgagguuccuaccucgcgggcgccgggcuagcauucucucugaugaaaucauugggaggcgggagaaggggaacaggcgcucagggugagacgcugggggagaaguggaagcgccaacucaaccagcuuagcaaauccgaauuuaauaccuauaagcggaguggaauuauggagguggauagaucugaagccaaagagggccugaagcguggugaaacuacaaaacacgcagucagcaggggcaccgcuaaguugcggugguucguggagcgcaaccugguaaagcccgaggggaaagugaucgaccucggauguggccgagggggauggucauacuauugcgccggcuuaaagaaaguuacugaagugaaggguuacacaaaagggggaccgggccaugaggaaccaauaccuauggccaccuacggcuggaaucuggucaagcuucacuccgggaaagauguguuuuucaugcccccagagaagugugacacgcugcuaugcgauauuggagaaaguagccccaacccuaccaucgaggaggguagaacacucaggguccugaagaugguggaaccgugguugcggggcaaucaguuuuguauuaaaauccugaaccccuauaugccaucuguuguagagacucucgaacagaugcaacgcaagcaugggggaaugcuugugagaaauccucuguccaggaacucaacccacgagauguacugggucagcugcggcacagguaauauagugucggcgguuaacaugacuucucgaauguuacugaaccgguucaccauggcucaccguaaacccacauaugagagagacguggauuugggggcaggaacccgccaugucgccguggaaccugaggaagcuaaucucgacaucauuggccagaggaucgagaacauuaagaaugaacacaaaaguacuuggcauuacgaugaggacaacccauauaagacgugggccuaccacggcuccuaugagguaaagcccagcgggucagcauccucuauggugaauggaguuguccggcugcuaacaaaaccuugggaugugaucccaauggugacccagauugccaugacugacaccacacccuuuggucaacagagagucuucaaggaaaaaguugacacgcgcaccccgagggcuaagcgaggcacuacacagaucauggaggugaccgcgaaauggcuuuggggguuucugagccggaacaagaagccuagaauauguacuagggaagaguucacacgcaaaguacguaguaaugccgcaauuggagcuguguuugucgaugaaaaccaguggaauuccgccaaggaggcaguggaggacgaacgguucugggaucucguucacagagagagggaacugcauaaacaaggcaagugcgccaccugcguguacaacaugauggguaaacgcgagaagaaguugggggaauuuggaaaagcuaagggcagccgagccaucugguacauguggcugggcgcgcgguuccucgaguucgaggcacuuggguuuaugaaugaagaccacugguucucuagagagaacucacugaguggagucgaaggugagggcuuacauaaacugggguauaucuugagggauauuuccaagauaccaggaggcaauauguacgccgacgauacagcugguugggacacucgcaucaccgaggaugaccuccagaacgaagccaaaauuacggauaucauggagcccgaacacgcacugcuagcuaccagcauuuuuaagcuuacauaucagaauaaagugguaagaguucagcggccugccaagaacgggacugugauggacgucaucucuaggcgugaucaacgaggaucgggccaggugggcaccuacgggcugaacacauucacuaauauggaggugcagcucauacgccagauggaaucagagggaaucuuucugccaagcgaguuggaaacccccaacuuagcugagagaguccuggacuggcucgaaaagcauggugccgagcggcuuaaaaggauggcaauuuccggcgacgauuguguugugaagccgaucgacgaucgcuucgcgacggcccugacagcucuaaaugacauggggaaaguaagaaaggauauuccucaaugggaacccaguaaaggauggaacgacuggcagcaggugccauuuugcucucaccacuuccaucagcugaucaugaaggauggccgggagauagucgugccuuguaggaaucaagacgagcucguuggucgagcccgugugagccagggggcaggaugguccuugagagaaaccgcuugccugggcaagucauaugcccagauguggcaacuuauguacuuucaccgccgggaucugaggcucgcagccaacgcgauuuguagugcuguccccguggacuggguaccaacuucuagaacaaccuggagcauccaugcccaccaccaguggaugacuaccgaggauauguuauccguuuggaaucgcguguggaucgaagagaaccccuggauggaagacaaaacacaugucucaagcugggaggaggugccuuaucugggcaagcgggaagaccaguggugcgggucuuugauuggacugacggcaagggccaccugggcuacuaauauacagguugccaucaaccaagugcgaagacucauugguaaugagaacuaccuugauuacaugacauccaugaaacgguucaagaaugaaagugacccagagggcgcacugugguga

SEQ ID NO: 13239 - RNA, 9879 nt, Artificial Sequence
  derived and/or modified CDS sequence (opt3) from DENV-1__GQ868560__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucauacaauguggcacgugacucggggugcaguucucauguaucaggggaaaagauuggaaccuuccugggccucaauuaagaaagaccugauaaguuacggaggcggcuggagguuccaggggagcuggaacaccggagaggaggugcaagucaucgcgguggaacccgguaagaauccaaaaaacguacagacgacacccggcacuuuuaagaccccugagggggaagucggagcuauugcccucgauuucaagccaggcacauccgguucucccaucgugaaucgagaggggaaaauuguuggacuguacggcaacggcguggucaccacuucggggaccuaugugagcgcaaucgcccaggcuaaggccucacaagaaggaccucuuccggagauagaggacgaaguuuuuaaaaagcggaaucugacaaucauggauuugcacccagguuccggcaaaacgcgcagauaccuacccgcaauugugagggaggcuaucaagcggaagcugcgaacucucauuuuagccccuaccagagucguggcgagugaaauggccgaggcacugaaagggaugccaauccgcuaucagacaaccgcuguaaagucugaacauacuggaagggagauaguggaccuuaugugccacgccacauucaccaugcgucugcucagccccguucgggucccuaacuacaauaugauuaucauggaugaggcucauuuuacggacccggcauccaucgccgccagaggcuauauuucaacuaggguggguaugggggaagcugcggcaaucuucaugacagccacccccccaggaucuguggaggcuuuuccucagagcaacgccgucauacaggaugaagagcgcgacauucccgaacgaaguuggaauuccggcuacgauuggaucaccgacuucccaggcaaaacuguaugguuugugccuagcauuaagucugggaacgauaucgcaaauuguuugagaaaaaacggaaagcggguuauacaacugucaaggaagacauucgacaccgaguaucagaaaacaaagaacaaugacugggauuacguggucacuacggacauuuccgagaugggugccaacuuccgcgcugaucgugugaucgaccccagacggugccucaaaccaguuauccugaaggauggcccggaaagggugauucuugcggggccuaugcccgucaccguggccagugcagcucagcgccgaggaagaaucggccggaaucagaacaaagagggugaccaauacguauauauggggcagccacuaaauaacgaugaagaccacgcccauuggacagaggcaaagaugcuguuggauaauauuaacacucccgagggcauaaucccugccuuauuugaaccagagagggaaaagagcgcugccauugacggagaguaccgccugagaggcgaagcgaggaaaaccuucguggagcucaugcggcguggggaucugcccguuuggcuuucguauaaggucgcaucugagggauuucaguacuccgaccgccgauggugcuucgauggugaaagaaauaaccaggugcuggaggaaaauauggacguggagaucuggacaaaagaaggcgagaggaagaaacuccggccucgcugguuggacgccagaaccuauagcgauccgcuggcucuaagggaguuuaaggaauucgccgcugggcggcgaucagucaguggagaccugauccucgagauuggcaaacuuccacaacaccugacuuuaagagcacagaacgccuuggauaaucugguuaugcuccacaacucugaacagggugggaaggcuuaccgccaugccauggaggaacugcccgacacgauagagacccuuaugcugcucgcauugaucgcggugcugacaggcggaguaacuuuauuuuuccuauccggcaaggggcugggaaaaaccagcauuggucuccuuugugugacagccucaagugcucuguuguggauggccagcgucgagccucacuggaucgcagcuuccauuauccuggaauuuuuccucauggugcugcuuauacccgagccagauaggcagcggaccccucaagacaaucagcucgccuauguugugaucggccuguuguuuaugauucugacugucgcagccaacgaaaugggguuacuagagacaacgaagaaagaucugggaaucggcuacguagcugcggagaaccaucagcacgccaccaugcucgacguggaucuucgucccgcaucugcuuggacucuguacgccguugccacaaccgugauuaccccaaugaugagacacacaaucgaaaauacuacggcaaacauaagcuugaccgcuauugccaaucaagcggcuauccugaugggucucgacaagggguggccuauuuccaaaauggauaucggcgucccgcugcuugccuuaggaugcuauucacaggugaacccccugacacucacugcagccgucuugaugcugguggcucauuacgcaauaaucggcccagggcuacaggccaaggcgaccagggaggcucagaagcgcacagccgcaggaauuaugaaaaauccuaccguugacggcaucguggccauugaucuggaccccguaguguaugacgcuaaguucgaaaaacaacucggucagaucaugcuucugauauuguguacuucucagauucugcucaugcggacgacaugggcccugugcgagaguaucaccuuagcaacugggccacuuaccacacugugggaaggaucgccuggcaaguuuuggaacacuaccaucgcugucagcauggccaauauuuuccgagguuccuaccucgcgggcgccgggcuagcauucucucugaugaaaucauugggaggcgggagaaggggaacaggcgcucagggugagacgcugggggagaaguggaagcgccaacucaaccagcuuagcaaauccgaauuuaauaccuauaagcggaguggaaucauggagguugauagaucugaagccaaagagggccugaagcguggugaaacuacaaaacacgcagugagcaggggcaccgcuaaguugcggugguucgucgagcgcaaccuggugaagcccgaggggaaaguaauagaccucggauguggccgagggggauggucauacuauugcgccggcuuaaagaaagugacugaaguuaaggguuacacaaaagggggaccgggccaugaggaaccaauuccuauggccaccuacggcuggaaucuggugaagcuucacuccgggaaagaugucuuuuucaugcccccagagaagugugacacgcugcuaugcgauaucggagaaaguagccccaacccuaccauugaggaggguagaacacucagggugcugaagauggucgaaccgugguugcggggcaaucaguuuuguaucaaaauacugaaccccuauaugccaucugugguugagacucucgaacagaugcaacgcaagcaugggggaaugcuuguaagaaauccucuguccaggaacucaacccacgagauguacugggugagcugcggcacagguaauaucgucucggcggugaacaugacuucucgaauguuacugaaccgguucaccauggcucaccguaaacccacauaugagagagacguugauuugggggcaggaacccgccauguggccgucgaaccugaggaagcuaaucucgacauuaucggccagaggauugagaacaucaagaaugaacacaaaaguacuuggcauuacgaugaggacaacccauauaagacgugggccuaccacggcuccuaugaggugaagcccagcgggucagcauccucuaugguaaauggagugguucggcugcuaacaaaaccuugggaugucauuccaauggugacccagaucgccaugacugacaccacacccuuuggucaacagagaguguucaaggaaaaagucgacacgcgcaccccgagggcuaagcgaggcacuacacagauaauggagguuaccgcgaaauggcuuuggggguuucugagccggaacaagaagccuagaauuuguacuagggaagaguucacacgcaaagugcguaguaaugccgcaaucggagcuguauuuguggaugaaaaccaguggaauuccgccaaggaggcagucgaggacgaacgguucugggaucucgugcacagagagagggaacugcauaaacaaggcaagugcgccaccugcguuuacaacaugauggguaaacgcgagaagaaguugggggaauuuggaaaagcuaagggcagccgagccaucugguacauguggcugggcgcgcgguuccucgaguucgaggcacuuggguuuaugaaugaagaccacugguucucuagagagaacucacugaguggaguggaaggugagggcuuacauaaacugggguauauuuugagggauauauccaagaucccaggaggcaauauguacgccgacgauacagcugguugggacacucgcauuaccgaggaugaccuccagaacgaagccaaaaucacggauauuauggagcccgaacacgcacugcuagcuaccagcaucuuuaagcuuacauaucagaauaaagucgugagaguacagcggccugccaagaacgggacuguuauggacgugauaucuaggcgugaucaacgaggaucgggccaggucggcaccuacgggcugaacacauucacuaauauggaggugcagcucauccgccagauggaaucagagggaauuuuucugccaagcgaguuggaaacccccaacuuagcugagagagugcuggacuggcucgaaaagcauggugccgagcggcuuaaaaggauggcaaucuccggcgacgauugugucguuaagccgauugacgaucgcuucgcgacggcccugacagcucuaaaugacauggggaaagugagaaaggauaucccucaaugggaacccaguaaaggauggaacgacuggcagcagguaccauuuugcucucaccacuuccaucagcugauaaugaaggauggccgggagauuguggucccuuguaggaaucaagacgagcucgugggucgagcccguguuagccagggggcaggaugguccuugagagaaaccgcuugccugggcaagucauaugcccagauguggcaacuuauguacuuucaccgccgggaucugaggcucgcagccaacgcgaucuguagugcugugcccgucgacugggugccaacuucuagaacaaccuggagcauccaugcccaccaccaguggaugacuaccgaggauauguuauccguauggaaucgcguuuggauugaagagaaccccuggauggaagacaaaacacaugugucaagcugggaggaggucccuuaucugggcaagcgggaagaccaguggugcgggucuuugauaggacugacggcaagggccaccugggcuacuaauauccagguggccauuaaccaaguucgaagacucaucgguaaugagaacuacauugauuacaugacauccaugaaacgguucaagaaugaaagugacccagagggcgcacuuugguga

SEQ ID NO: 13240 - RNA, 9879 nt, Artificial Sequence
  derived and/or modified CDS sequence (opt3) from DENV-1__GQ868561__SS-prME
agcgugaccaugcugcucaugcuucugcccacugccuuggcuuuccacuuaacuacgagaggaggggagccucauaugaucgucuccaagcaggaaagaggaaaaucucugcuauuuaagaccucagcugguguuaacaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcuccccaugucggcuugggucucgagacuagaaccgaaacauggauguccucugagggggccuggaaacagauccagaggguggaaacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagauuucguggagggucuuagcggcgcgacuuggguagacguuguguuggagcacgggaguugugucacaaccauggcaaagaauaaacccacucuggauaucgaacuacucaagacagaggugaccaacccugccgugcugaggaaacuuugcauugaagcuaagaucuccaauacgaccacagacucucgguguccaacucaaggagaggccacccuggucgaagaacaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaaggacuggauuggauuuuaacgaaaugguccuacugacaaugaaggagaaaagcuggcucgugcauaagcagugguuccuggaccuuccgcugcccuggacgucuggcgcauccaccucacaagagacuuggaaucggcaggauuugcucguaacauuuaaaaccgcucacgccaagaagcaggaaguugugguccuggguagccaagagggggcuaugcacacagccuuaacuggcgcaaccgaaauccagacgaguggaaccacaacuauuuucgccggccaucugaaaugccgucuaaagauggacaaacucacccugaaggggaugucuuaugugauguguacaggauccuucaaacuugagaaggaagucgcugagacucagcacgguaccguguugguucaggugaaguacgagggcacggaugcgccuugcaaaauaccauuuagcacacaagacgaaaaggggguaacccagaacggacgccugaucacugcaaaucccauugucacagauaaagagaagccugugaacaucgaaaccgagccacccuucggcgagucguauauaguugugggugccggggaaaaagcucucaagcugucuugguuuaagaaaggcuccucaauuggaaagauguucgaggccacugcaagaggcgccaggcggauggcuauccuuggggacaccgccugggauuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagccgaucaacaagucuauccaugaccuguauagcggugggcauggugacacucuaccugggggucaugguucaggcugacagcggaugcgugaucaacuggaaaggccgcgaacuuaagugugguucugggauuuuugugacuaacgagguacacaccuggacggaacaauauaaguuccaggccgauucaccgaaaagauugagugcagccaucggaaaggcuugggaggagggcgucugcgguaucaggagcgccacacggcuggaaaauauuauguggaaacagauauccaacgagcucaaucauauccuguuagaaaacgacaugaaguuuaccgugguugugggcgacgcaaaugggauucuggcucagggcaagaagaugauccgcccucaacccauggagcacaaauacucuuggaagucguggggcaaggccaaaauuaucggggcggauauacagaacacuaccuucaucauugacggaccagauacaccugaaugucccgacggccagagagccuggaauaucugggaggucgaggauuaugguuuugggauuuucacuaccaacaucuggcuuaaguugagggacagcuacacacagaugugcgaucaccgucucauguccgcugcaauaaaagacucaaaggccgugcaugcugauaugggauauuggauugaaagugagaaaaaugaaacguggaagcuggcccgggcaucuuucaucgagguuaagaccuguacuuggccaaaaagccacacacuaugguccaacggcgugcuggaaucagagaugauuauccccaagauauacgguggcccuaucagccaacauaauuaucgaccaggguacuuuacccagacugcgggaccguggcaccucggcaaacuggagcuugacuucgauuugugcgaagggacaaccguagucguggacgagcacugcggaaacagaggccccucucugaggacgacuaccgugacagguaagauuauccaugaaugguguugccgcuccuguaccuuaccuccacuccgguuuagaggggaggauggaugcugguacggcauggagauuaggcccgucaaagaaaaggaggaaaaucugguucgcaguauggugagcgccgguucuggcgagguagacuccuucucacuugggauccugugugugaguauaaugauugaagaggucaugcgaagccgguggucgcguaagauguugaugacuggaacacucgcuguguuucugcuacugaucaugggccagcucaccuggaacgaccugaucagacuuugcauuaugguuggggccaaugcauccgauaggaugggaaugggcacaacuuauuuggcucugauggccaccuucaaaaugcgcccuauguuugcaguggguuuacucuuccggagacugacgucuagggagguccuucugcuaacaaucgggcucagccugguggccucaguugaauugccaaacagucuggaggaauuaggagacggccucgcuaugggcauuaugaugcugaaacuucugaccgaguuucaaccccaccaguuguggacuacccuccugucccuaacauucgugaaaacuacccugucucuugauuacgcguggaagacgacagccaugguccucagcauaguaucccuguuuccguugugucugucaaccacuagccagaaaacaaccugguuaccugugcuccuggggaguuucggaugcaagccacuuacuauguuucugaucacagaaaacaagauuuggggucgaaaaucuuggcccuugaaugagggcaucauggcaauugggaucguuuccauacuccugagcucgcuacugaagaacgacgugccucuugcuggaccccucaucgccggcgguaugcugauugccuguuaugucaucucagggucuagugcugauuuguccuuagagaaagcagccgaagugagcugggagcaggaagcggagcauucuggagcuagccacaauauucugguagaagugcaagacgauggcaccaugaagaucaaagacgaggagcgcgaugacacgcucacuauacugcuuaaggccacccuguuggcagucuccggcguuuacccaaugucaauuccugccacacuauucgugugguauuucuggcagaaaaagaagcagcggaguggggugcugugggauacccccagcccaccggaagucgagagagcugugcucgacgauggaaucuacaggauccugcagcguggucuuuuaggccgcucucaaguugggguaggaguguuucaggacggcgucuuccauacaauguggcacgugacucggggugcaguucugauguaucaggggaaaagacucgaaccuuccugggccucagugaagaaagacuugauuaguuacggaggcggcuggagguuucaggggagcuggaacaccggagaggagguccaagugauagcgguagaacccgguaagaaucccaaaaauguccagacgacacccggcacuuucaagaccccugagggggaagugggagcuaucgcccuggauuuuaagccaggcacauccgguucucccauuguuaaucgagaggggaaaaucgugggacucuacggcaacggcgucgugaccacuucggggaccuauguuagcgcaauugcccaggcuaaggccucacaagaaggaccucugccggagaucgaggacgaaguguucaaaaagcggaaucuuacaauaauggaucugcacccagguuccggcaaaacgcgcagauacuugcccgcaaucgucagggaggcuauuaagcggaagcuacgaacucugauccucgccccuaccagagugguagcgagugaaauggccgaggcauuaaaagggaugccaauucgcuaucagacaaccgcugugaagucugaacauacuggaagggagaucguugaccugaugugccacgccacauuuaccaugcgucuucugagccccguccgggugccuaacuacaauaugauaauuauggaugaggcucauuucacggacccggcauccaucgccgccagaggcuauaucucaacuaggguggguaugggggaagcugcggcaauuuuuaugacagccacaccaccaggaucugucgaggcuuucccucagagcaacgccguaauccaggaugaagaacgcgacauacccgaacgaaguuggaacuccggcuacgauuggauuaccgacuuuccaggcaaaacugugugguucguuccuagcaucaagucugggaacgauauugcaaauugucucaggaaaaacggaaagcgggugauccaauugucaaggaagacauucgacaccgaguaucagaaaacaaagaacaaugacugggauuacgucgugacuacggacauauccgagaugggugccaacuuucgcgcugaucguguuauugaccccagacggugccugaaaccagugauccucaaggauggcccggaaagggucauccuggcggggccuaugcccgugaccguagccagugcagcucagcgccgaggaagaauuggccggaaucagaacaaagagggugaccaauacguguauauggggcagccacuuaauaacgaugaagaccacgcccauuggacagaggcaaagaugcuacuggauaauaucaacacucccgagggcauuauaccugccuuguucgaaccagagagggaaaagagcgcugccaucgacggagaguaccgcuuaagaggcgaagcgaggaaaaccuuuguugagcugaugcggcguggggaucuccccgucuggcugucguauaagguggcaucugagggauuccaguacuccgaccgccgauggugcuuugauggugaaagaaauaaccaggugcuugaggaaaauauggacgucgagauuuggacaaaagaaggcgagaggaagaaacugcggccucgcuggcucgacgccagaaccuauagcgauccguuggcucugagggaguucaaggaauuugccgcugggcggcgaucaguuaguggagaccuaauccuggagaucggcaaacucccacaacaccuuacucugagagcacagaacgccuuagauaauuuggugaugcugcacaacucugaacagggugggaaggcuuaccgccaugccauggaggaacuccccgacacgauugagacccugaugcuucuggcacucauagcgguauugacaggcggagugacucuguucuuuuuauccggcaaggggcuaggaaaaaccagcaucggucugcucugugucacagccucaagugcacuucuguggauggccagcguggagccucacuggauugcagcuuccaucauuuuggaguucuuucugaugguucuccugauccccgagccagauaggcagcggaccccucaagacaaucagcuugccuauguggucauaggccuccuguucaugaucuugacuguagcagccaacgaaauggggcuguuagagacaacgaagaaagaucuaggaauuggcuacguggcugcggagaaccaucagcacgccaccaugcuggacguugaucuccgucccgcaucugcuuggacucuuuacgccguggccacaaccgucaucaccccaaugaugagacacacaauugaaaauacuacggcaaacaucagccugaccgcuauagccaaucaagcggcuauuuugaugggucuggacaagggguggccuaucuccaaaauggauauuggcgugccgcuccuggcccuuggaugcuauucacaggucaaccccuuaacacugacugcagccgugcucauguugguugcucauuacgcaaucauaggcccagggcugcaggccaaggcgaccagggaggcucagaagcgcacagccgcaggaaucaugaaaaauccuaccguggacggcauuguagccaucgaucuagaccccguggucuaugacgcuaaguuugaaaaacaacugggucagauuaugcuccuuauccuguguacuucucagauauugcugaugcggacgacaugggcccucugcgagaguauuacccuggcaacugggccauuaaccacacuuugggaaggaucgccuggcaaguucuggaacacuaccaucgcuguuagcauggccaauaucuuccgagguuccuaccuggcgggcgccgggcucgcauuuucucuaaugaaaucacugggaggcgggagaaggggaacaggcgcucagggugagacguugggggagaaguggaagcgccaacugaaccagcucagcaaauccgaguucaauaccuauaagcggaguggaauuauggagguggauagaucugaagccaaagagggccuuaagcguggugaaacuacaaaacacgcagucagcaggggcaccgcuaagcugcggugguuuguggagcgcaacuugguaaagcccgaggggaaagugaucgaccugggauguggccgagggggauggucauacuauugcgccggccucaagaaaguuacugaagugaaggguuacacaaaagggggaccgggccaugaggaaccaauaccuauggccaccuacggcuggaauuuagucaagcugcacuccgggaaagauguguucuuuaugcccccagagaagugugacacgcuucugugcgauauuggagaaaguagccccucuccuaccaucgaggaggguagaacacuaaggguccucaagaugguggaaccguggcugcggggcaaccaguucuguauuaaaaucuugaaucccuauaugccauccguuguagagacucuggaacagaugcaacgcaagcaugggggaaugcucgugagaaacccucuuucaaggaauagcacccacgagauguacugggucucgugcggcacagguaacauagugucugcgguuaauaugacaagucgaaugcuguuaaaccgguuuaccauggcucaccguaaacccacauaugagagagacguggaucugggggcaggaacccgccaugucgccguggaaccugagguagcuaacuuggacaucauuggccagaggaucgaaaauauuaagaacgagcacaaauccacuuggcauuacgaugaagacaauccauauaagacgugggccuaccacggcagcuaugaggugaagcccucaggguccgcaucuagcaugguuaacggagucgugcggcuccugacaaaaccuugggaugugaucccaauggucacccagauugccaugacugacaccacacccuucggucaacagagaguuuuuaaggagaaaguggacacgcgcaccccgagggcuaagcgaggcacuacacagaucauggaaguaaccgcgaaauggcuauggggguuccuuagucggaauaagaagccuagaauauguacuagggaggaauuuacacgcaaagugcguuccaacgccgcaauuggagcugucuucguggaugagaaucaguggaacagcgccaaggaagcaguugaggacgagcgguuuugggaucuggugcacagagaaagggagcuccauaaacaaggcaagugcgcaaccugcgucuacaauaugauggguaaacgcgaaaagaagcugggggaguucggaaaagcuaagggcucucgagccaucugguacaugugguugggcgcgcgguuccuggaauuugaggcacucggguucaugaacgaggaccacugguuuucaagagaaaauagucuuuccggaguggagggugaaggccugcauaaauuaggguauauccugagggauauuagcaagauaccaggaggcaacauguacgccgacgauacagcugguugggacacucgcaucaccgaggaugacuugcagaaugaggccaaaauuacggauaucauggaacccgagcacgcacuccuggcuaccucuauuuucaagcuaacauaucagacuaaaguaguuagagugcagcggccugccaagaacgggaccgucauggacgugaucucgaggcgugaucaacgaggaucaggccaggugggcacauacgggcuuaauacuuuuaccaacauggaaguccagcugauacgccagauggagagcgaaggaaucuuccucccauccgagcuggagacgcccaacuuggcugaaagaguuuuagacuggcuggagaagcauggugccgaacggcucaaaaggauggcaauuaguggcgacgauugugugguaaagccgaucgacgaucgcuuugcgacagcccuuaccgcucugaaugacauggggaaagugagaaaggauauuccucaaugggagcccucuaaaggauggaacgacuggcagcaggucccauucugcagccaccacuuucaucagcuaaucaugaaggauggccgggaaauagugguuccuuguaggaaucaagacgagcuggugggucgagcccgugucucccagggggcaggauggucacucagagagacugcuugcuugggcaagaguuaugcccagauguggcaacugauguacuuccaccgccgggaucuuaggcuggcagccaacgcgauuuguucugcugugcccguagacuggguuccaacaagcagaaccacuugguccauccaugcccaccaccaguggaugaccacagaagauaugcucucaguguggaaucgcgucuggaucgaggaaaaccccuggauggaggacaaaacgcaugugagcucuugggaagagguuccuuauuuaggcaagcgggaggaccaguggugcgggucccugauuggauugaccgcaagggccacuugggcuacaaauauacagguggccaucaaccaaguccgaagacugauugguaaugaaaacuaccucgauuacaugaccaguaugaaacgguuuaagaaugagagcgacccagaaggcgcacuuugguga

SEQ ID NO: 13241 - RNA, 9879 nt, Artificial Sequence
  derived and/or modified CDS sequence (opt3) from DENV-1__GU131948__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagauccugcuacucacaauugggcugagcuuggucgccucaguggaacugccaaacaguuuagaggaacucggagacggccuggcuaugggcauaaugaugcuuaagcuguugaccgaguuccaaccccaccagcucuggacuacccugcuaucccugacauuuguuaaaacuacccuuucucucgauuacgcguggaagacgacagccauggugcugagcaucgucuccuuguucccgcuguguuuaucaaccacuagccagaaaacaaccuggcucccuguacugcuugggaguuuuggaugcaagccacugacuauguucuugauuacagaaaacaagaucuggggucgaaaaucuuggccccucaaugagggcauuauggcaaucgggauaguguccauccugcuaagcucgcugcuuaagaacgacguuccucucgcuggaccccugauugccggcgguauguugaucgccuguuaugugauuucagggucuagugcugauuuaucccuggagaaagcagccgaagucagcugggagcaggaagcggagcauucuggagcuagccacaauauccucguggaaguacaagacgauggcaccaugaagauaaaagacgaggagcgcgaugacacgcugacuauucuucugaaggccaccuugcuagcaguguccggcgucuacccaaugucaaucccugccacacuguuuguuugguauuucuggcagaaaaagaagcagcggaguggggugcucugggauacccccagcccaccggaaguggagagagcuguccuggacgauggaaucuacaggauucuucagcgugguuuacugggccgcucucaaguggggguuggaguauuccaggacggcguguuucauacaauguggcacgucacucggggugcagugcucauguaucaggggaaaagauuggaaccuuccugggccucaguuaagaaagaccugauaaguuacggaggcggcuggagguuccaggggagcuggaacaccggagaggaggugcaagucaucgcgguggaacccgguaagaauccaaaaaacguacagacgacacccggcauuuuuaagacuccugagggggaagucggagcuaucgcccucgauuucaagccaggcaccuccgguucucccauugugaaucgagaggggaaaaucguuggacuguacggcaacggcguggucacaaccucggggacuuaugugagcgcaauagcccaggcuaaggccucacaagaaggaccucuuccggagaucgaggacgaaguuuuuaaaaagcggaaucugaccauuauggauuugcacccagguuccggcaaaacacgcagauaccuacccgcaaucgugagggaggcuauuaagcggaagcugcgaacgcucaucuuagccccuacuagagucguggcgagugaaauggccgaggcacugaaagggaugccaauacgcuaucagaccacagcuguaaagucugaacauaccggaagggagauuguggaccuuaugugccacgccacuuucacaaugcgucugcucagccccguucgggucccuaacuacaauaugaucaucauggaugaggcucauuuuaccgacccggcauccauugccgccagaggcuauaucucaacgaggguggguaugggggaagcugcggcaauauucaugacugccacacccccaggaucuguggaggcuuuuccucagagcaacgccgucauucaggaugaagagcgcgacauccccgaacgaaguuggaauuccggcuacgauuggauuaccgacuucccaggcaaaaccguaugguuugugccuagcaucaagucugggaacgauauagcaaauuguuugagaaaaaacggaaagcggguuauucaacugucaaggaagacuuucgacacagaguaucagaaaaccaagaacaaugacugggauuacguggucacaacugacaucuccgagaugggugccaacuuccgcgcugaucgugugaucgaccccagacggugccucaaaccaguuauucugaaggauggcccggaaagggugauccuugcggggccuaugcccgucacgguggccagugcagcucagcgccgaggaagaauuggccggaaucagaacaaagagggugaccaauacguauauauggggcagccacuaaauaacgaugaagaccacgcccauuggaccgaggcaaagaugcuguuggauaauauaaacacacccgagggcaucauuccugccuuauuugaaccagagagggaaaagagcgcugccaucgacggagaguaccgccugagaggcgaagcgaggaaaacuuucguggagcucaugcggcguggggaucugcccguuuggcuuucguauaaggucgcaucugagggauuucaguacuccgaccgccgauggugcuucgauggugaaagaaauaaccaggugcuggaggaaaauauggacguggagaucuggaccaaagaaggcgagaggaagaaacuccggccucgcugguuggacgccagaacauauagcgauccgcuggcucuaagggaguuuaaggaauucgccgcugggcggcgaucaauuaguggagaccugauacucgagaucggcaaacuuccacaacaccugaccuuaagagcacagaacgccuuggauaaucuggucaugcuccacaacucugaacagggugggaaggcuuaccgccaugccauggaggaacugcccgacacuauugagacgcuuaugcugcucgcauugaucgcgguucugaccggcggagugacauuauuuuuccuauccggcaaggggcugggaaaaacuagcauuggucuccuuuguguaaccgccucaagugcucuguuguggauggccagcguggagccucacuggaucgcagcuuccauaauccuggaauuuuuccucaugguccugcuuauucccgagccagauaggcagcggacaccucaagacaaucagcucgccuaugugguuaucggccuguuguuuaugauucugaccguggcagccaacgaaaugggguuacuagagacuacaaagaaagaucugggaaucggcuacgucgcugcggagaaccaucagcacgccacgaugcucgacguagaucuucgucccgcaucugcuuggacccuguacgccguggccacuacaguuauaaccccaaugaugagacacaccauugaaaauacaacugcaaacaucagcuugacggcuauugccaaucaagcggcuauccugaugggucucgacaagggguggccuauauccaaaauggauaucggcgugccgcugcuugccuuaggaugcuauucacaggucaacccccugacccucacagcagccguguugaugcuggucgcucauuacgcaauuaucggcccagggcuacaggccaaggcgacuagggaggcucagaagcgcaccgccgcaggaauuaugaaaaauccuacaguggacggcaucguugccauagaucuggaccccgugguauaugacgcuaaguucgaaaaacaacucggucagauuaugcuucugaucuuguguaccucucagauccugcucaugcggacuacgugggcccugugcgagaguauuacauuagcaaccgggccacuuacuacccugugggaaggaucgccuggcaaguuuuggaacacaacuaucgcugugagcauggccaauauauuccgagguuccuaccucgcgggcgccgggcuagcauucucucugaugaaaucauugggaggcgggagaaggggaaccggcgcucagggugagacacugggggagaaguggaagcgccaacucaaccagcuuagcaaauccgaauuuaauacguauaagcggaguggaauuauggaggucgauagaucugaagccaaagagggccugaagcguggugaaaccacuaaacacgcaguuagcaggggcacagcuaaguugcggugguucguggagcgcaaccuggucaagcccgaggggaaagugaucgaccucggauguggccgagggggauggucauacuauugcgccggcuuaaagaaaguaaccgaagugaaggguuacacuaaagggggaccgggccaugaggaaccaauuccuauggccacauacggcuggaaucugguuaagcuucacuccgggaaagauguguuuuucaugcccccagagaagugugacacccugcuaugcgauaucggagaaaguagccccaacccuacgauagaggaggguagaacccucaggguccugaagaugguggaaccgugguugcggggcaaucaguuuuguaucaaaauucugaaccccuauaugccaucugucguggagacacucgaacagaugcaacgcaagcaugggggaaugcuuguuagaaauccucuguccaggaacucaacucacgagauguacuggguaagcugcggcaccgguaauaucgugucggcggucaacaugacaucucgaauguuacugaaccgguucacuauggcucaccguaaacccaccuaugagagagacguggauuugggggcaggaacacgccauguugccguggaaccugaggucgcuaaucucgacauuaucggccagaggauugaaaacaucaagaaugagcacaaaaguaccuggcauuacgaugaagacaacccauauaagacuugggccuaccacggcuccuaugaggugaagcccagcgggucagcauccucuaugguaaauggagugguucggcugcuaacgaaaccuugggaugucauaccaauggugacacagauugccaugaccgacacuacccccuuuggucaacagagaguguucaaggagaaagucgacacacgcacgccgagggcuaagcgaggcaccacucagaucauggaaguuacagcgaaauggcuuuggggguuucugagccggaacaagaagccuagaaucuguaccagggaggaauucacucgcaaagugcguaguaaugccgcaauuggagcuguauuuguggaugagaaccaguggaauuccgccaaggaagcagucgaggacgagcgguucugggaucucgugcacagagaaagggagcugcauaaacaaggcaagugcgccacaugcguuuacaacaugauggguaaacgcgaaaagaaguugggggaguuuggaaaagcuaagggcagccgagccauaugguacauguggcugggcgcgcgguuccucgaauucgaggcacuuggguuuaugaaugaggaccacugguucucuagagaaaacucacugaguggaguggagggugaaggcuuacauaaacugggguauaucuugagggauauuuccaagaucccaggaggcaauauguacgccgacgauaccgcugguugggacacacgcauuacugaggaugaccuccagaacgaggccaaaaucaccgauauaauggaacccgagcacgcacugcuagcuacgagcaucuuuaagcuuaccuaucagaauaaagucgugagaguacagcggccugccaagaacgggacaguuauggacgugauuucuaggcgugaucaacgaggaucgggccaggucggcacuuacgggcugaacaccuucacaaauauggaagugcagcucauccgccagauggagucagaaggaauuuuucugccaagcgaguuggagacucccaacuuagcugaaagagugcuggacuggcucgagaagcauggugccgaacggcuuaaaaggauggcaaucuccggcgacgauugugucguuaagccgauagacgaucgcuucgcgaccgcccugacggcucuaaaugacauggggaaagugagaaaggauacaccucaaugggagcccaguaaaggauggaacgacuggcagcagguaccauuuugcucucaccacuuccaucagcugauuaugaaggauggccgggaaaucguggucccuuguaggaaucaagacgagcucgugggucgagcccguguuagccagggggcaggaugguccuugagagagaccgcuugccugggcaagucauaugcccagauguggcaacuuauguacuuucaccgccgggaucugaggcucgcagccaacgcgaucuguagugcugugcccgucgacugggugccaacuucuagaacaaccuggagcauucaugcccaccaccaguggaugacuaccgaagauauguuauccguauggaaucgcguuuggauagaggaaaaccccuggauggaggacaaaacacaugugucaagcugggaagaggucccuuaucugggcaagcgggaggaccaguggugcgggucuuugaucggacugacggcaagggccaccugggcuacuaauauucagguggccaucaaccaaguucgaagacucauugguaaugaaaacuaccuugauuacaugacauccaugaaacgguucaagaaugagagugacccagaaggcgcacugugguga

SEQ ID NO: 13242 - RNA, 9879 nt, Artificial Sequence
  derived and/or modified CDS sequence (opt3) from DENV-1__GQ868562__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcagcacgaaaaccucaaauacuccgucauugugacaguucauaccggagaucagcaccaaguggguaaugagacuacggaacauggcacaaucgccaccauuacuccccaggcgccuaccucagagauccagcuuacagacuauggggcccugaccuuggacuguaguccaaggacuggacuagauuucaacgaaaugguccugcucacaaugaaggagaaaagcuggcuggugcacaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcauacagcccugacuggcgcaaccgaaauccagacgaguggaaccacaacuauuuuugccggccaccuaaaaugccgucucaagauggacaaacugacccuuaaggggaugucuuacgugauguguacaggauccuucaaauuggagaaggaagucgcugagacucagcaugguaccgugcugguucaggugaaguaugagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguacauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaccagguguucggaacggcauauggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacauaccuggacggaacaauacaaguuucaggccgauucaccgaaaagacugagugcagccaucggaaaggcuugggaggagggcgucugcgguaucaggagcgccacacggcucgaaaauauuauguggaaacagauauccaacgagcugaaucacaucuuacuggaaaacgacaugaaguucaccgugguugugggcgacgcaaaugggauucuugcucagggaaaaaagaugauccgcccucaacccauggagcacaaauauucuuggaagucguggggcaaggccaaaauuaucggggcggauauacagaacacuaccuuuaucauugacggaccagauacaccugaaugucccgacggccagagagccuggaauaucugggaggucgaggauuacgguuucgggauuuuuacuaccaacaucugguugaagcucagggacagcuauacacagaugugcgaucaucgucugauguccgcugcaauaaaagacucaaaggccgugcacgcugauaugggauacuggauugaaagugagaaaaaugaaacguggaagcuagcccgggcaucuuucaucgagguuaagaccuguacuuggccaaaaagccauacacugugguccaacggcgugcucgaaucagagaugauuauccccaagauauaugguggcccuaucagccaacacaauuaccgaccaggguauuucacccagacugcgggaccguggcaccugggcaaacuugaguuggacuuugaucugugcgaagggacaaccguagucguggacgagcauugcggaaacagaggccccucuuuaaggacgacuaccgugacagguaagauuauccacgaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacucaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucacacaauguggcaugugacucggggugcaguucucauguaucaggggaaaagauuggaaccuuccugggccucagugaagaaagaccugauuaguuacggaggcggcuggagguuccaggggagcuggaacaccggagaggagguccaagugauagcgguagaacccgguaagaauccaaaaaacguccagacgacacccggcacuuuuaagaccccugagggggaagugggagcuaucgcccucgauuucaagccaggcacauccgguucucccauuguuaaucgagaggggaaaaucgugggacuguauggcaacggcgucgugaccacuucggggaccuacguuagcgcaauugcccaggcuaaggccucacaagaaggaccucuuccggagaucgaggacgaaguguuuaaaaagcggaaucugacaauaauggauuugcacccagguuccggcaaaacgcgcagauaccuacccgcaaucgucagggaggcuauuaagcggaagcugcgaacucucaucuuagccccuaccagagugguagcgagugaaauggccgaggcacugaaagggaugccaauucgcuaucagacaaccgcugugaagucugaacauacuggaagggagaucguugaccuuaugugccacgccacauucaccaugcgucugcucagccccguccgggugccuaacuacaauaugauaauuauggaugaggcucauuuuacggacccggcauccaucgccgccagaggcuauaucucaacuaggguggguaugggggaagcugcggcaauuuucaugacagccacccccccaggaucugucgaggcuuuuccucagagcaacgccguaauccaggaugaagagcgcgacauacccgaacgaaguuggaauuccggcuacgauuggauuaccgacuucccaggcaaaacugugugguuuguuccuagcaucaagucugggaacgauauugcaaauuguuugagaaaaaacggaaagcgggugauccaacugucaaggaagacauucgacaccgaguaucagaaaacaaagaacaaugacugggauuacgucgugacuacggacauauccgagaugggugccaacuuccgcgcugaucguguuauugaccccagacggugccucaaaccagugauccugaaggauggcccggaaagggucauccuugcggggccuaugcccgugaccguagccagugcagcucagcgccgaggaagaauuggccggaaucagaacaaagagggugaccaauauguguacauggggcagccacuaaauaacgaugaagaccacgcccacuggacagaggcaaagaugcuguuggauaauaucaacacucccgagggcauuauaccugccuuauuugaaccagagagggaaaagagcgcugccaucgacggagaguaccgccugagaggcgaagcgaggaaaaccuucguugagcucaugcggcguggggaucugcccgucuggcuuucguauaagguggcaucugagggauuucaguacuccgaccgccgauggugcuucgauggugaaagaaauaaccaggugcuggaggaaaauauggacgucgagauuuggacaaaagaaggcgagaggaagaaacuccggccucgcugguuggacgccagaaccuauagcgauccgcuggcucuaagggaguuuaaggaauucgccgcugggcggcgaucaguuaguggagaccugauccucgagaucggcaaacuuccacaacaucugacuuuaagagcacagaacgccuuggauaaucuggugaugcuccacaacucugaacagggugggaaggcuuaccgccaugccauggaggaacugcccgacacgauugagacccuuaugcugcucgcauugauagcgguacugacaggcggagccacuuuauuuuuccuauccggcaaggggcugggaaaaaccagcaucggucuccuuugugugacagcuucaagugcccuguuguggauggcaagcgucgagccucacuggauugcugccuccaucauucuggaauuuuuccucauggugcugcuuauccccgagccagauaggcagcggaccccucaagacaaucagcucgcauauguugugauaggccuguuguuuaugauccugacugucgccgcuaacgaaaugggguuacuagagacaacgaagaaagaucugggaauuggcuacguagcggccgagaaccaccagcaugcaaccaugcucgacguggaucuucgucccgcuucugccuggacucuguaugccguugcaacaaccgugaucaccccaaugaugagacacacaauugaaaauacuacggcuaacaucagcuugaccgccauagcgaaucaagcugccauucugaugggucucgacaagggguggccuaucuccaaaauggauauuggcgucccgcugcuugcauuaggaugcuacucacaggugaacccccugacacucacugccgcugucuugaugcugguggcacauuacgccaucauaggcccagggcuacaggcgaaggcuaccagggaggcccagaagcgcacagcagccggaaucaugaaaaauccuaccguugacggcauuguggcuaucgaucuggaccccguaguguaugacgccaaguucgaaaaacaacucggucagauuaugcuucugaucuuguguacuucucagauacugcucaugcggacgacaugggcacugugcgagaguauuaccuuagcuacugggccacuuaccacacugugggaaggaucgccuggcaaguuuuggaacacuaccaucgccgucagcauggcgaauaucuuccgagguuccuaccucgccggcgcagggcuagcuuucucucugaugaaaucauugggaggcgggagaaggggaacaggcgcccagggugagacgcugggggagaaguggaagcgccaacucaaccagcuuagcaaauccgaauuuaauaccuauaagcggaguggaauuauggagguugauagaucugaagcaaaagagggccugaagcguggugaaacuacaaaacacgcugugagcaggggcaccgccaaguugcggugguucgucgagcgcaaccuggugaagcccgaggggaaaguaaucgaccucggauguggccgagggggauggucauacuauugcgccggcuuaaagaaagugacugaaguuaaggguuacacaaaagggggaccgggccaugaggaaccaauaccuauggcgaccuauggcuggaaucuggugaagcuucacuccgggaaagaugucuuuuucaugcccccagagaagugugacacgcugcuaugcgauauuggagaaaguagccccaacccuaccaucgaggaggguagaacacucagggugcugaagauggucgaaccgugguugaaaggcaaucaguuuuguauuaagauccugaaccccuacaugccaucugugguugagacucucgaacagaugcaacggaaacacgggggaaugcuuguacgcaauccucuguccagaaacucaacccaugagauguacugggugagcugcggcacagguaauauagucucggcugugaacaugacuucuaggauguuacugaaccgauucaccauggcacaccggaagcccacauaugagcgugacguugauuugggggccggaaccagacauguggcugucgaaccugagguggccaaucucgacaucauuggccagcgcaucgaaaacauuaaaaaugagcacaagaguacuuggcacuacgaugaagacaacccauauaagacgugggcauaccauggcuccuaugagguaaaacccagcgggucagccuccucuauggugaauggaguugucaggcugcuaacaaagccuugggaugugaucccaauggugacccagauugcuaugacugacaccacacccuuuggucaacagcgggucuucaaagagaagguugacacgagaaccccgcgcgcgaaaaggggcacuacacagaucauggaagugaccgccaaguggcuuuggggguuucugagccgaaacaagaaaccucggauauguacuagagaggaauucacaaggaagguacgcaguaaugcagcuauuggagccguguuugucgaugagaaccaguggaauuccgcaaaagaagccguggaggacgagcguuucugggaucucguucaccgggaaagagagcugcauaagcaaggcaaaugcgcuaccugcguguacaacaugauggguaagagggaaaagaaauugggggaguuuggaaaggccaaaggcagccgcgcgaucugguauauguggcugggcgcacgauuccucgaauucgaggcccuuggguuuaugaaugaggaccacugguucucucgggaaaacucacugaguggagucgagggugaaggcuuacauaagcugggguacaucuugagagauauuuccaaaauaccaggaggcaauauguacgcugacgauacagccgguugggacacuaggaucaccgaggaugaccuccagaacgaggcaaagauuacggauaucauggaacccgagcacgcucugcuagccaccagcauuuuuaaacuuacauaucagaauaaggugguacgcguucagagaccugcuaagaacgggacugugauggacgucaucucucggagggaucaacguggaucgggccaggugggcaccuacgggcugaacacauucacuaauauggaagugcagcucauacgacagauggagucagaaggaaucuuucugccaagcgaguuggagacccccaacuuagccgaacgcguccuggacuggcucgagaaacacggugcagaaagacuuaagcggauggcgauuuccggcgacgauuguguugugaaaccgaucgacgauagguucgccacggcucugacagcccuaaaugacauggggaagguacgcaaagauauuccucaaugggagcccaguaagggauggaacgacuggcagcaggugccauuuugcucucaucacuuccaucagcugaucaugaaggauggcagagaaauagucgugccuugucggaaucaagacgagcucguugguagggcacgagugagccagggggcuggaugguccuugcgugagaccgccugccugggcaaaucauaugcacagauguggcaacuuauguacuuucacagacgcgaucugcggcucgccgcgaacgcuauuuguagugccguccccguggacuggguaccaacuucuaggacaaccuggagcauccacgcacaucaccaguggaugacuaccgaagauauguuauccguuuggaauagaguguggaucgaggaaaaccccuggauggaggacaagacacaugucucaagcugggaagaggugccuuaucugggcaaacgcgaggaccaguggugcgggucuuugauuggacugacggcccgggcuaccugggccacuaauauacagguugcaaucaaccaagugaggcgacucauugguaaugaaaacuaccuugauuauaugacauccaugaagagauucaaaaaugagagugacccagaaggcgcucugugguga

SEQ ID NO: 13243 - RNA, 9879 nt, Artificial Sequence
  derived and/or modified CDS sequence (opt3) from DENV-1__GQ868563__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacgccacuuuuaucauugacggaccagauaccccugaaugucccgacggccagagagcuuggaauaucugggaggucgaggauuaugguuucgggauuuuuacaacuaacaucugguugaagcucagggacagcuacacccagaugugcgaucaccgucugauguccgcagccauaaaagacucaaaggcugugcaugccgauaugggauauuggauugaaagugagaaaaaugaaacauggaagcuagcacgggcgucuuucaucgagguuaagacguguaccuggccaaaaagccacacucugugguccaacggcgugcucgaaucagagaugauuauccccaagauauacgguggcccuaucagccaacauaauuaucgaccaggguacuucacacagaccgccggaccguggcaccugggcaaacuugaguuggacuuugaucugugcgaagggacuacaguagucguggacgagcacugcggaaacagaggccccucuuuaaggaccacgacugugaccgguaagauuauccaugaaugguguugccgcuccuguacacucccuccacugcgguucagaggggaggauggaugcugguacggcauggagauuaggcccgucaaagaaaaggaggaaaaucuuguucgcaguauggugagcgcugguucuggcgagguagacuccuuuucacuggggaucuugugugugaguauaaugauugaagaggucaugcgaagccgguggucgcguaagaugcucaugaccggaacucuggccguguuccuacugcucaucaugggccagcugacauggaacgaccuuaccagauugugcaucaugguuggggcaaaugcuuccgauaggaugggaaugggcacaacuuaucuggccuuaauggcaaccuuuaaaaugcgcccuauguucgccgugggucuccuguuucggagacuuacgucuagggagguccugcuacucacaauugggcugagcuugguggcuucaguugaacugccaaacaguuuagaggaacucggagacggccuggcgaugggcaucaugaugcuuaagcuguugaccgaguuccaaccccaccagcucuggacuacccugcuaucccugacauuugugaaaacuacccuuucucucgauuacgccuggaagacgacagcaaugguccugagcauuguauccuuguucccgcuguguuuaucaaccacuagccagaaaacaaccuggcucccugugcugcuugggaguuuuggaugcaagccacugacuauguucuugauaacagaaaacaagaucuggggucgaaaaucuuggccccucaaugagggcauuauggcuaucgggauuguuuccauccugcuaagcucgcugcuuaagaacgacgugccucucgccggaccccugauagccggcgguauguugaucgcuuguuaugucauuucagggucuagugcagauuuaucccuggagaaagccgcggaagugagcugggagcaggaagcugagcauucuggagccagccacaauauccucguagaagugcaagacgauggcaccaugaagauuaaagacgaggagcgcgaugacacgcugacuauccuucugaaggcaaccuugcuagccgucuccggcguuuacccaaugucaauaccugcuacacuguuugugugguauuucuggcagaaaaagaagcagcggaguggggugcucugggauacccccagcccaccggaagucgagagagcagugcuggacgauggaauuuacaggauccuucagcgugguuuacugggccgcucucaaguugggguaggaguguuccaggacggcgucuuucauacaauguggcacgugacucggggugccguucucauguaucaggggaaaagauuggaaccuuccugggcgucagugaagaaagaccugaucaguuacggaggcggcuggagguuccaggggcucuggaacaccggagaggagguccaagugauugcuguagaacccgguaagaauccaaaaaacguccagacgacacccggcacuuuuaagaccccugagggggaagugggagccauagcacuggauuucaagccaggcacaagcgguucccccaucguuaaucgagaggggaaaauugugggacuuuacggcaacggcgucgugaccacuucugggaccuauguuucggccaucgcucaggccaaggcaagccaagaaggaccucugccggagauugaggacgaaguguuuaaaaagcggaauuugacaaucauggaucuacacccagguucaggcaaaacgcgcagauaccugcccgcuauagucagggaggccaucaagcggaagcuccgaacuuuaauucuggcgccuaccagagugguagccuccgaaauggcagaggcucuuaaagggaugccaauccgcuaucagacaaccgccgugaagagugaacauacuggaagggagauuguugaccugaugugccacgcuacauucaccaugcgucucuugucucccguccgggugccuaacuacaauaugaucauaauggaugaggcacauuuuacggacccggccagcauugccgcuagaggcuauaucuccacuaggguggguaugggggaagcggcagccaucuucaugacagcuacccccccaggaucagucgaggccuuuccucagucuaacgcaguaauucaggaugaagagcgcgacauccccgaacgaagcuggaauaguggcuacgauuggauaaccgacuucccaggcaaaacugugugguuuguuccuuccauuaagagcgggaacgauaucgccaauugucugagaaaaaacggaaagcgggugauucaacucucuaggaagacauucgacaccgaguaucagaaaacaaagaacaaugacugggauuacgucgugacuacggacaucucagagaugggugcuaacuuccgcgcggaucguguuauagaccccagacggugccugaaaccagugauucuuaaggauggcccggaaagggucauccuagccgggccuaugcccgugaccguagcauccgcugcccagcgccgaggaagaaucggccggaaucagaacaaagagggugaccaauacguguauauggggcagccacugaauaacgaugaagaccacgcacauuggacagaggccaagauguuguuagauaauauuaacacucccgagggcaucauuccugcucuguuugaaccagagagggaaaagagugccgcgauagacggagaguaccgccucagaggcgaagcaaggaaaaccuucguugagcugaugcggcguggggaucuucccgucuggcugagcuauaagguggccucggagggauuucaguacucugaccgccgauggugcuucgauggugaaagaaauaaccaggugcucgaggaaaauauggacgucgagaucuggacaaaagaaggcgagaggaagaaauugcggccucgcuggcuggacgcuagaaccuauuccgauccgcuagcccugagggaguuuaaggaauucgcugcagggcggcgaagcguuucaggagaccucauucuugagaucggcaaacugccacaacacuuaacuuugagagcccagaacgcucuggauaaucucgugaugcugcacaacagugaacagggugggaaggccuaccgccaugcaauggaggaacuucccgacacgaucgagacccugaugcucuuggcgcugauugccguauuaacaggcggagugacucuauuuuuccugucuggcaaggggcucggaaaaaccuccauaggucuucugugugucacagcuagcucagccuugcuguggauggcaaguguggagccucacuggaucgcugccagcauuauccucgaauuuuuccugaugguucuucucauucccgagccagauaggcagcggaccccucaagacaaucagcuggcauauguggucaucggcuugcuguuuaugauauuaacuguagccgcuaacgaaauggggcuacuggagacaacgaagaaagaucucggaaucggcuacgcggccgcagagaaccaucagcacgcuaccaugcuugacguggaucugcgucccgccuccgccuggacuuuguacgcaguugcuacaaccgugauuaccccaaugaugagacacacaaucgaaaauacuacggccaacauuucucugaccgcgaucgcuaaucaagccgcaauacucaugggucuggacaagggguggccuauuagcaaaauggauaucggcgucccgcuuuuagcccugggaugcuauucccaggugaacccccucacauugacugcugcaguccugaugcuaguggcccauuacgcgauuaucggcccagggcugcaggcuaaggccaccagggaggcacagaagcgcacagccgcuggaauaaugaaaaauccuaccguugacggcaucguggccauugaucucgaccccguaguguaugacgcaaaguucgaaaaacaacuuggucagaucaugcuguugauucuguguacuucacagauccuccugaugcggacgacaugggcuuuaugcgagucuauaacccuugccacugggccacugaccacacucugggaaggaaguccuggcaaguuuuggaacacuaccauugcggucucgauggccaauaucuuccgagguagcuaccuagcaggcgcugggcuggccuucuccuugaugaaaucucugggaggcgggagaaggggaacaggcgcacagggugagacgcucggggagaaguggaagcgccaacuuaaccagcugucaaaaagcgaauuuaauaccuauaagcgguccggaaucauggagguugauagaagugaagcuaaagagggcuugaagcguggugaaacuacaaaacacgccgugucuaggggcaccgccaagcugcggugguucgucgagcgcaaccucgugaagcccgaggggaaaguaauugacuuaggauguggccgagggggauggagcuacuauugcgcgggccugaagaaagugacugaaguuaaggguuacacaaaagggggaccgggccaugaggaaccaaucccuauggcuaccuacggcuggaaucuugugaagcugcacucagggaaagaugucuuuuucaugcccccagagaagugugacacgcuacucugcgauauaggagaauccagucccaacccuaccauugaggaggguagaacacugaggguguugaagauggucgaaccguggcugcggggcaaucaguuuuguaucaaaauucucaaccccuauaugccaagcgugguugagacucuugaacagaugcaacgcaagcaugggggaaugcugguaagaaauccuuuaucuaggaacuccacccacgagauguacugggugucaugcggcacagguaauaucgucagcgcagugaacaugacuucgcgaaugcuguugaaccgguucaccauggcccaccguaaacccacauaugagagagacguugaucucggggcuggaacccgccauguggccgucgaaccugaggugccaaaucuggacauaaucggccagaggauugaaaacaucaagaaugagcacaaaucuacuuggcauuacgaugaagacaaccccuauaagacgugggcauaccacggcaguuaugagguaaagccuuccgggagcgccucauccauggugaauggaguuguccggcuacuuacaaaaccaugggaugugauucccauggugacccagaucgcuaugacugacaccacaccguuuggucaacagagagucuucaaggagaaaguugacacgcgcaccccuagggcgaagcgaggcacuacacagauuauggaagugaccgccaaauggcuguggggguuucucucucggaacaagaagccaagaaucuguacuagggaggaauucacacgcaaaguacguagcaaugcagcuauaggagccguguuugucgaugagaaccaguggaauagugcaaaggaagccguggaggacgagcgguucugggaucugguucacagagaaagggaguugcauaaacaaggcaagugcgcuaccugcguguacaacaugauggguaaacgcgaaaagaagcugggggaguuuggaaaagccaagggcucccgagcgauuugguacauguggcucggcgcacgguuccuugaauucgaggcccugggguuuaugaaugaggaccacugguucagcagagaaaacucuuuaucaggagucgagggugaaggccugcauaaauugggguauauccucagggauaucaguaagauucccggaggcaauauguacgcugacgauacagccgguugggacacucgcauaaccgaggaugaccugcagaacgaggcaaaaaucacggauauuauggaaccugagcacgcucuacuugccaccuccaucuuuaagcugacauaucagaauaaagugguaagaguucagcggccagcuaagaacgggacugugauggacgucauuagcaggcgugaucaacgaggaucuggccaggugggcaccuacgggcucaacacauucacuaauauggaagugcagcugauccgccagauggagucggaaggaauauuuuugcccucagaguuagagaccccgaaccuggccgaaagaguccucgacuggcuugagaagcauggugcagaacggcugaaaaggauggcgaucagcggcgacgauuguguugugaagccuauugacgaucgcuucgccacggcucuaacagcccugaaugacauggggaaaguaagaaaggauaucccccaaugggagccauccaaaggauggaacgacuggcagcaggugccuuuuugcagucaccacuuccaucagcucauuaugaaggauggccgggaaaucgucgugcccuguaggaaucaagacgaguugguuggucgagcacgugugucucagggggcuggauggagccugagagagaccgccugccuuggcaaguccuaugcacagauguggcaacugauguacuuucaccgccgggaucucagguuagccgcgaacgcuauauguucagccgucccaguggaauggguacccacuaguagaacaaccuggucuauucaugcacaccaccaguggaugacuaccgaggacaugcugagcguuuggaaucgcguguggaucgaagagaacccuuggauggaagauaaaacacaugucuccucaugggaggaggugccauauuugggcaagcgggaagaccaguggugcgggagccugaucggacucacggccagggcuaccugggccacuaauauucagguugcaauaaaccaagugcgaagacuuaucgguaaugagaacuaccuggacuacaugacaucuaugaaacgguucaagaaugaauccgauccggagggcgcucuaugguga

SEQ ID NO: 13244 - RNA, 9879 nt, Artificial Sequence
  derived and/or modified CDS sequence (opt3) from DENV-1__GQ868564__SS-prME
agcgugaccaugcugcucaugcuucugcccacagccuuggcuuuccacuuaacuacgagaggcggggagccucauaugaucgucuccaagcaggaaaggggaaaagcacugcuauuuaagaccucugccgguguuaacaugugcacacucauugcgauggaccugggcgagcuuugugaagauacuaugaccuacaaaugcccacggauaacagaggcugaaccggacgauguggacuguuggugcaaugccaccgauacuuggguaacauaugggaccuguucacaaacgggagagcaccgccgagacaagcguaguguggcacuggccccccaugucggcuugggucucgagacuagaaccgaaacauggaugagcuccgagggggcuuggaaacagauccagaggguggaaacuugggcacugcggcacccuggauucaccguuauugcccuguuucucgcucaugccaucggcacaucuauuacccagaagggcaucauauucaucuuacugaugcuugugacgccaucgauggcgaugcgcugcgucgggauuggaaacagagauuuuguggaggguuugucaggcgcaacuuggguagacguugugcuggagcacgggagcugugucacaaccauggccaagaauaaacccacucuagauaucgaacuccugaagacagaggugaccaacccugcugugcuuaggaaacugugcauugaagccaagaucaguaauacgaccacagacucccgguguccaacucaaggagaggcaaccuuggucgaagagcaggaugcuaacuucguuugccgccgaacauuuguggacagaggcugggguaauggguguggacucuucggcaaaggcucucuguuaacuugcgccaaguuuaagugcguaaccaaacuggaggggaagauagugcaguacgaaaaccucaaauauagcgucauugugacaguucacaccggagaucagcaucaaguggguaaugagacuacggaacacggcacaaucgcgaccauuacuccccaggccccuaccuccgagauccagcuuacagacuacggggcacugaccuuggacuguucaccaaggacuggacuagauuucaacgaaaugguccugcucacaaugaaggagaaaaguuggcuggugcauaagcagugguuucuugaccugccguugcccuggacgagcggcgcuucuaccucccaagagacuuggaaucggcaggaucuccugguaacauucaaaaccgcccacgcuaagaagcaggaaguuguggucuuagguucacaagagggggccaugcacacagcacugacuggcgccaccgaaauccagacgagcggaaccacaacuauuuuugcuggccaucuaaaaugccgucucaagauggacaaacugacccuuaaggggaugaguuaugugauguguacaggaucuuucaaauuggagaaggaagucgcggagacucagcacgguaccgugcugguucaggugaaguacgagggcacggaugcaccuugcaaaauaccauucuccacacaagacgaaaaggggguaacccagaacggacgccucaucacugccaaucccauugucacagauaaagagaagccugugaacaucgaaaccgagccacccuuuggcgagagcuauauaguugugggugcuggggaaaaagcccugaagcuuucgugguucaagaaaggcucuuccauuggaaagauguuugaggcaacugccagaggcgcuaggcggauggccauccugggggacaccgcaugggauuucggaucaaucgguggcgucuuuacaaguguggggaaauugguacaucagguguucggaacggcguacggcguucucuuuagcggugucuccuggaccaugaagauugggaucggcauucuguuaacuuggcugggacuaaauucucgaagcacaucacucaguaugaccuguauagcugugggcauggugacacuguaccuuggggucaugguucaggccgacuccggaugcgugaucaacuggaaaggccgcgaauugaagugugguagcgggauuuucgugacuaacgagguacacaccuggacggaacaauauaaguuucaggcagauucuccgaaaagacugucagccgcuaucggaaaggccugggaggagggcgucugcgguaucaggagugcaacacggcucgaaaauauuauguggaaacagauaagcaacgagcugaaucauaucuuacuggaaaacgacaugaaguucaccgugguugugggcgacgcuaaugggauucuugcccagggaaaaaagaugauccgcccucaacccauggagcacaaauacuccuggaagucuuggggcaaggcgaaaauuaucggggccgauauacagaacacuaccuuuaucauugacggaccagauacaccugaaugucccgacggccagagagcuuggaauaucugggaggucgaggauuaugguuucgggauuuuuacuaccaacaucugguugaagcucagggacucguacacacagaugugcgaucaccgucugaugagcgcagccauaaaagacuccaaggcugugcaugccgauaugggauauuggauugaaucagagaaaaaugaaacguggaagcuagcacgggcgaguuucaucgagguuaagaccuguacuuggccaaaaucucacacacuguggagcaacggcgugcucgaauccgagaugauuauccccaagauauacgguggcccuaucucacaacauaauuaucgaccaggguacuucacccagacugccggaccguggcaccugggcaaacuugaguuggacuuugaucugugcgaagggacaaccguagucguggacgagcacugcggaaacagaggccccagcuuaaggacgacuaccgugacagguaagauuauccaugaaugguguugccgcucuuguacccucccuccacugcgguucagaggggaggauggaugcugguacggcauggagauuaggcccgucaaagaacgcgaggaaaaucuuguucgauccauggugagugcugguagcggcgagguagacucuuuuucccuggggaucuugugugugucaauaaugauugaagaggucaugcggagucguuggagcagaaagaugcucaugacuggaacacuggccguguuccuacugcucaucaugggccagcugaccuggaacgaccuuacaagguugugcaucaugguuggggcaaaugcuucggaucgcaugggaaugggcacuaccuaucuggccuuaauggcaacguuuaagaugcggccuauguucgccgugggucuccuguuuagaaggcuuacaucccgagagguccugcuacucaccauugggcugucuuugguggcuagcguugaacugccaaacucauuagaggaacucggagacggccuggcgaugggcaucaugaugcuuaaacuguugacugaguuccaaccccaccagcucuggaccacacugcuaagucugacuuuugugaagaccacgcuuucccucgauuacgccuggaaaacaaccgcaaugguccugucuauuguaagcuuguucccgcuguguuuauccacuacaucacagaagaccacuuggcucccugugcugcuugggagcuuuggaugcaaaccacugacaauguucuugauaaccgaaaacaagaucuggggucgcaagaguuggccccucaaugagggcauuauggcuaucgggauuguuucuauccugcuauccagccugcuuaaaaacgacgugccucucgccggaccccugauagccggcgguauguugaucgcuuguuaugucauuucggggucaucugcagauuuaagucuggagaaggccgcggaaguguccugggagcaugaagcugagcacagcggagccucucauaauauccucguagaagugcaggacgauggcacgaugaaaauuaaggacgaggagcgggaugacacucugaccauccuucugaaagcagccuugcuagcugucagcggcguuuacccaauguccauaccugcaacacuguuugugugguauuucuggcaaaagaaaaagcagagaucaggggugcucugggauacccccaguccaccggaagucgagagggccgugcuggacgauggaauuuaccguauccuucagcgcgguuuacugggccggagccagguugggguaggaguguuccaagacggcgucuuucacacaauguggcacgugacuagaggugcgguucucauguaucaggggaagagguuggaaccuucuugggcuuccgugaaaaaggaccugaucucauacggaggcggcuggcgauuccaggggaguuggaacaccggagaggagguccaggugauugccguagaacccgguaaaaauccaaagaacguccaaacgacacccggcacuuuuaaaaccccugagggggaagugggagcaauagcccucgauuucaagccaggcacaagcgguucccccaucguuaaucgggaggggaagauugugggacuguacggcaacggcgucgugaccacuucugggaccuauguuucggcuaucgcccaggcaaaagcuagccaggaaggaccucuuccggagauugaggacgaaguguuuaagaaacgcaaucugacaaucauggauuugcauccagguucaggcaagacgagaagguaccuacccgccauaguccgggaggcgaucaaacgaaagcugagaacucucauuuuagccccuacccgcgugguagcauccgaaauggcugaggcccugaaggggaugccaaucagguaucaaacaaccgcugugaaaagugaacacacuggacgugagauuguugaccuuaugugccaugcaacauucaccaugcggcugcucucucccgucagagugccuaacuacaauaugaucauaauggaugaggcccacuuuacggacccggccagcauugcugcgaggggcuauaucuccacucgcguggguaugggggaagcagccgcuaucuucaugacagccacccccccaggaucagucgaggcauuuccucagucuaacgccguaauucaggaugaagagcgagacauccccgaaagaagcuggaauaguggcuacgauuggauaaccgacuucccaggcaagacugugugguuuguuccuuccauuaaaagcgggaacgauaucgcuaauuguuugcggaagaacggaaaaagggugauucagcugucucgcaagacauucgacaccgaguaucaaaagacaaaaaacaaugacugggauuacgucgugacuacggacaucucagagaugggugcgaacuuccgugccgauagaguuauagacccccggaggugccucaagccagugauucugaaagauggcccggaacgcgucauccuugcagggccuaugcccgugaccguagcuuccgccgcacagcgaagaggacggaucggcaggaaucagaacaaggagggugaccaguacguguauauggggcaaccacuaaauaacgaugaagaccaugcccacuggacagaggcuaaaaugcuguuggauaauauuaacacucccgagggcaucauuccugccuuauuugaaccagagcgcgaaaagagugcggcaauagacggagaguacagacugaggggcgaagcccggaagaccuucguugagcucaugcgucgcggggaucugcccgucuggcuuagcuauaaaguggcuucggagggauuucaguacucugaccgaagauggugcuucgauggugaaaggaauaaccaggugcuggaggaaaauauggacgucgagaucuggacaaaggaaggcgagcggaaaaagcuccgcccuagaugguuggacgccaggaccuauuccgauccgcuggcucuacgggaguuuaaagaauucgcagccgggcgaagaagcguuucaggagaccugauucucgagaucggcaagcuuccacagcaccugacuuuacgcgcucaaaacgccuuggauaaucuggugaugcuccauaacagugaacagggugggaaagcauacaggcacgcgauggaggaacugcccgacacgaucgagacccuuaugcugcucgccuugauugcuguacugacaggcggagugacuuuauuuuuccuaucuggcaaggggcugggaaagaccuccauaggucuccuuugugucacagccagcucagcacuguuguggauggcuaguguggagccucauuggaucgccgcaagcauuauccuggaauuuuuccucaugguucugcuuauucccgagccagaucggcagcguaccccucaggacaaucaacucgccuauguggucaucggccuguuguuuaugauacugacuguagcugcgaacgaaaugggguuacuagagacaacgaaaaaggaucugggaaucggccacguggccgcagagaaccaccagcaugcuaccaugcucgacguugaucuuagacccgccuccgccuggacucuguacgcaguggcuacaaccgucauuaccccaaugaugaggcacacaaucgaaaauacuacggccaacauuucuuugaccgcgaucgcuaaucaggccgcaauacugaugggucucgacaaaggguggccuauuagcaagauggauaucggcgugccgcugcuugccuuaggaugcuacucccaagucaacccccugacacucacugcugcaguguugaugcugguugcccauuaugcgauuaucggcccagggcuacaggcuaaagccacccgcgaggcacagaagcggacagccgcuggaauaaugaagaauccuaccguggacggcaucguagccauugaucuggaccccguggucuacgacgcaaaauucgaaaagcagcucggucaaaucaugcuucugauuuuguguacuucacagauccugcucaugcgaacgacaugggcucugugcgagucuauaaccuuagccacugggccacuuaccacacugugggaaggaaguccuggcaaauuuuggaacacuaccauugcgguuucgauggccaauaucuucagagguagcuaucucgcaggcgcugggcuagccuucucccugaugaagucuuugggaggcgggaggcgcggaacaggcgcacagggugagacgcugggggagaaauggaagcggcagcucaaccaacuuucaaagagcgaauuuaauaccuacaaaagauccggaaucauggagguggaucguagugaagcuaaggagggccugaaaaggggugaaacuacaaagcacgccgucucucggggcaccgccaaauugcgcugguucguggagcgaaaccugguaaagcccgaggggaaggugauugaccucggauguggcagagggggauggagcuauuacugcgcgggcuuaaaaaagguuacugaagugaaagguuauacaaaggggggaccgggccaugaggaaccaaucccuauggcuaccuacggcuggaaucuggucaaacuucacucagggaaggauguguuuuucaugcccccagagaaaugugacacgcugcuaugcgauauaggagaauccagucccaacccuaccauugaggaggguaggacacuccggguccugaagaugguggaaccgugguugcgcggcaaucaguuuuguaucaagauucugaaccccuacaugccaagcguuguagagacucucgaacagaugcagagaaaacacgggggaaugcuugugaggaauccucugucucgaaacuccacccaugagauguauugggucucaugcggcacagguaauaucgugagcgcaguuaacaugacuucgcggauguuacugaaccguuucaccauggcccacagaaagcccacauacgagcgcgacguggauuugggggcuggaaccaggcaugucgccguggaaccugagguagcaaaucucgacauaaucggccaacggauugaaaacaucaaaaaugagcacaagucuacuuggcacuaugaugaagacaacccauacaaaacgugggccuaucauggcaguuacgaggugaagcccuccgggagcgcuucauccaugguuaauggagucgugagacugcuaacaaagccuugggaugugauuccaauggucacccagaucgcgaugacugacaccacacccuuuggucagcaacgcguuuucaaagagaagguggacacgaggaccccgcgagccaaacggggcacuacacagauuauggaaguaaccgcaaaguggcuuuggggguuucugucuagaaacaaaaagccuaggaucuguacucgcgaggaauucacacguaaggugcggagcaaugcugccauaggagcagucuuuguggaugagaaccaguggaauagugccaaagaagcuguugaggacgagagauucugggaucucgugcacagggaacgcgagcugcauaagcagggcaaaugcgccaccugcgucuauaacaugauggguaagcgagaaaaaaaguugggggaguuuggaaaggcgaaaggcucccgggcaauuugguacauguggcugggcgccagauuccucgaauucgaggcucuuggguuuaugaaugaggaccacugguucagcagggaaaacucucugucaggaguggagggugaaggcuuacauaagcugggguacaucuugcgcgauaucaguaaaauuccaggaggcaauauguaugccgacgauacagcagguugggacacuagaauaaccgaggaugaccuccaaaacgaggcuaagaucacggauauuauggaacccgagcacgcccugcuagcuaccuccaucuuuaaacuuacauaccagaauaagguaguucgggugcagaggccugccaaaaacgggacugucauggacgugauuagccgucgagaucagcgcggaucuggccaagugggcaccuaugggcugaacacauucacuaauauggaaguccagcucaucagacagauggagucggaaggaauauuucugccaucagaguuggagacccccaacuuagcagaacggguucuggacuggcucgagaagcacggugcggaaaggcuuaagcgcauggccaucagcggcgacgauugugugguaaaaccgauugacgauagauucgcuacggcccugacagcacuaaaugacauggggaaggugcggaaagauaucccucagugggagcccuccaagggauggaacgacuggcaacaggucccauuuugcagucaucacuuccaucagcugauuaugaaagauggcagggaaaucgugguuccuugucgaaaucaggacgagcucgugggucgugcuagagucucucaaggggccggauggagcuugcgcgagaccgcaugccugggcaaguccuacgcccagauguggcagcuuauguauuuucaccggagggaucugagacucgcggcuaacgccauauguucagcagugcccguagaauggguuccaacuagucgcacaaccuggucuauucacgcccaucaccaauggaugacuaccgaggacauguuaagcguguggaaucgggucuggaucgaagagaaccccuggauggaagauaagacacauguguccucaugggaggagguuccuuaccugggcaaaagggaagaccaguggugcgggagcuugaucggacugacggcucgagccaccugggcaacuaauauucagguggcuauaaaccaggucagacggcucaucgguaaugagaacuaucuugacuacaugacaucuaugaagagguucaaaaaugaauccgauccagagggcgcccugugguga

SEQ ID NO: 13245 - RNA, 9879 nt, Artificial Sequence
  derived and/or modified CDS sequence (opt3) from DENV-1__GQ868565__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacgccacuuuuaucauugacggaccagauaccccugaaugucccgacggccagagagcuuggaauaucugggaggucgaggauuaugguuucgggauuuuuacaacuaacaucugguugaagcucagggacagcuacacccagaugugcgaucaccgucugauguccgcagccauaaaagacucaaaggcugugcaugccgauaugggauauuggauugaaagugagaaaaaugaaacauggaagcuagcacgggcgucuuucaucgagguuaagacguguaccuggccaaaaagccacacucugugguccaacggcgugcucgaaucagagaugauuauccccaagauauacgguggcccuaucagccaacauaauuaucgaccaggguacuucacacagaccgccggaccguggcaccugggcaaacuugaguuggacuuugaucugugcgaagggacuacaguagucguggacgagcacugcggaaacagaggccccucuuuaaggaccacgacugugaccgguaagauuauccaugaaugguguugccgcuccuguacacucccuccacugcgguucagaggggaggauggaugcugguacggcauggagauuaggcccgucaaagaaaaggaggaaaaucuuguucgcaguauggugagcgcugguucuggcgagguagacuccuuuucacuggggaucuugugugugaguauaaugauugaagaggucaugcgaagccgguggucgcguaagaugcucaugaccggaacucuggccguguuccuacugcucaucaugggccagcugacauggaacgaccuuaccagauugugcaucaugguuggggcaaaugcuuccgauaggaugggaaugggcacaacuuaucuggccuuaauggcaaccuuuaaaaugcgcccuauguucgccgugggucuccuguuucggagacuuacgucuagggagguccugcuacucacaauugggcugagcuugguggcuucaguugaacugccaaacaguuuagaggaacucggagacggccuggcgaugggcaucaugaugcuuaagcuguugaccgaguuccaaccccaccagcucuggacuacccugcuaucccugacauuugugaaaacuacccuuucucucgauuacgccuggaagacgacagcaaugguccugagcauuguauccuuguucccgcuguguuuaucaaccacuagccagaaaacaaccuggcucccugugcugcuugggaguuuuggaugcaagccacugacuauguucuugauaacagaaaacaagaucuggggucgaaaaucuuggccccucaaugagggcauuauggcuaucgggauuguuuccauccugcuaagcucgcugcuuaagaacgacgugccucucgccggaccccugauagccggcgguauguugaucgcuuguuaugucauuucagggucuagugcagauuuaucccuggagaaagccgcggaagugagcugggagcaggaagcugagcauucuggagccagccacaauauccucguagaagugcaagacgauggcaccaugaagauuaaagacgaggagcgcgaugacacgcugacuauccuucugaaggcaaccuugcuagccgucuccggcguuuacccaaugucaauaccugcuacacuguuugugugguauuucuggcagaaaaagaagcagcggaguggggugcucugggauacccccagcccaccggaagucgagagagcagugcuggacgauggaauuuacaggauccuucagcgugguuuacugggccgcucucaaguugggguaggaguguuccaggacggcgucuuucauacaauguggcacgugacucggggugccguucucauguaucaggggaaaagauuggaaccuuccugggcgucagugaagaaagaccugaucaguuacggaggcggcuggagguuccaggggcucuggaacaccggagaggagguccaagugauugcuguagaacccgguaagaauccaaaaaacguccagacgacacccggcacuuuuaagaccccugagggggaagugggagccauagcacuggauuucaagccaggcacaagcgguucccccaucguuaaucgagaggggaaaauugugggacuuuacggcaacggcgucgugaccacuucugggaccuauguuucggccaucgcucaggccaaggcaagccaagaaggaccucugccggagauugaggacgaaguguuuaaaaagcggaauuugacaaucauggaucuacacccagguucaggcaaaacgcgcagauaccugcccgcuauagucagggaggccaucaagcggaagcuccgaacuuuaauucuggcgccuaccagagugguagccuccgaaauggcagaggcucuuaaagggaugccaauccgcuaucagacaaccgccgugaagagugaacauacuggaagggagauuguugaccugaugugccacgcuacauucaccaugcgucucuugucucccguccgggugccuaacuacaauaugaucauaauggaugaggcacauuuuacggacccggccagcauugccgcuagaggcuauaucuccacuaggguggguaugggggaagcggcagccaucuucaugacagcuacccccccaggaucagucgaggccuuuccucagucuaacgcaguaauucaggaugaagagcgcgacauccccgaacgaagcuggaauaguggcuacgauuggauaaccgacuucccaggcaaaacugugugguuuguuccuuccauuaagagcgggaacgauaucgccaauugucugagaaaaaacggaaagcgggugauucaacucucuaggaagacauucgacaccgaguaucagaaaacaaagaacaaugacugggauuacgucgugacuacggacaucucagagaugggugcuaacuuccgcgcggaucguguuauagaccccagacggugccugaaaccagugauucuuaaggauggcccggaaagggucauccuagccgggccuaugcccgugaccguagcauccgcugcccagcgccgaggaagaaucggccggaaucagaacaaagagggugaccaauacguguauauggggcagccacugaauaacgaugaagaccacgcacauuggacagaggccaagauguuguuagauaauauuaacacucccgagggcaucauuccugcucuguuugaaccagagagggaaaagagugccgcgauagacggagaguaccgccucagaggcgaagcaaggaaaaccuucguugagcugaugcggcguggggaucuucccgucuggcugagcuauaagguggccucggagggauuucaguacucugaccgccgauggugcuucgauggugaaagaaauaaccaggugcucgaggaaaauauggacgucgagaucuggacaaaagaaggcgagaggaagaaauugcggccucgcuggcuggacgcuagaaccuauuccgauccgcuagcccugagggaguuuaaggaauucgcugcagggcggcgaagcguuucaggagaccucauucuugagaucggcaaacugccacaacacuuaacuuugagagcccagaacgcucuggauaaucucgugaugcugcacaacagugaacagggugggaaggccuaccgccaugcaauggaggaacuucccgacacgaucgagacccugaugcucuuggcgcugauugccguauuaacaggcggagugacucuauuuuuccugucuggcaaggggcucggaaaaaccuccauaggucuucugugugucacagcuagcucagccuugcuguggauggcaaguguggagccucacuggaucgcugccagcauuauccucgaauuuuuccugaugguucuucucauucccgagccagauaggcagcggaccccucaagacaaucagcuggcauauguggucaucggcuugcuguuuaugauauuaacuguagccgcuaacgaaauggggcuacuggagacaacgaagaaagaucucggaaucggcuacgcggccgcagagaaccaucagcacgcuaccaugcuugacguggaucugcgucccgccuccgccuggacuuuguacgcaguugcuacaaccgugauuaccccaaugaugagacacacaaucgaaaauacuacggccaacauuucucugaccgcgaucgcuaaucaagccgcaauacucaugggucuggacaagggguggccuauuagcaaaauggauaucggcgucccgcuuuuagcccugggaugcuauucccaggugaacccccucacauugacugcugcaguccugaugcuaguggcccauuacgcgauuaucggcccagggcugcaggcuaaggccaccagggaggcacagaagcgcacagccgcuggaauaaugaaaaauccuaccguugacggcaucguggccauugaucucgaccccguaguguaugacgcaaaguucgaaaaacaacuuggucagaucaugcuguugauucuguguacuucacagauccuccugaugcggacgacaugggcuuuaugcgagucuauaacccuugccacugggccacugaccacacucugggaaggaaguccuggcaaguuuuggaacacuaccauugcggucucgauggccaauaucuuccgagguagcuaccuagcaggcgcugggcuggccuucuccuugaugaaaucucugggaggcgggagaaggggaacaggcgcacagggugagacgcucggggagaaguggaagcgccaacuuaaccagcugucaaaaagcgaauuuaauaccuauaagcgguccggaaucauggagguugauagaagugaagcuaaagagggcuugaagcguggugaaacuacaaaacacgccgugucuaggggcaccgccaagcugcggugguucgucgagcgcaaccucgugaagcccgaggggaaaguaauugacuuaggauguggccgagggggauggagcuacuauugcgcgggccugaagaaagugacugaaguuaaggguuacacaaaagggggaccgggccaugaggaaccaaucccuauggcuaccuacggcuggaaucuugugaagcugcacucagggaaagaugucuuuuucaugcccccagagaagugugacacgcuacucugcgauauaggagaauccagucccaacccuaccauugaggaggguagaacacugaggguguugaagauggucgaaccguggcugcggggcaaucaguuuuguaucaaaauucucaaccccuauaugccaagcgugguugagacucuugaacagaugcaacgcaagcaugggggaaugcugguaagaaauccuuuaucuaggaacuccacccacgagauguacugggugucaugcggcacagguaauaucgucagcgcagugaacaugacuucgcgaaugcuguugaaccgguucaccauggcccaccguaaacccacauaugagagagacguugaucucggggcuggaacccgccauguggccgucgaaccugagguggcaaaucuggacauaaucggccagaggauugaaaacaucaagaaugagcacaaaucuacuuggcauuacgaugaagacaacccauauaagacgugggccuaccacggcaguuaugagguaaagcccuccgggagcgcuucauccauggugaauggaguuguccggcuacuuacaaaaccuugggaugugauuccaauggugacccagaucgcgaugacugacaccacacccuuuggucaacagagagucuucaaggagaaaguugacacgcgcaccccgagggccaagcgaggcacuacacagauuauggaagugaccgcaaaauggcuguggggguuucucucucggaacaagaagccuagaaucuguacuagggaggaauucacacgcaaaguacguagcaaugcugccauaggagcaguguuugucgaugagaaccaguggaauagugccaaggaagcuguggaggacgagcgguucugggaucugguucacagagaaagggaguugcauaaacaaggcaagugcgccaccugcguguacaacaugauggguaaacgcgaaaagaagcugggggaguuuggaaaagcgaagggcucccgagcaauuugguacauguggcucggcgcccgguuccuugaauucgaggcucugggguuuaugaaugaggaccacugguucagcagagaaaacucuuuaucaggagucgagggugaaggccugcauaaauugggguauauccucagggauaucaguaagauuccaggaggcaauauguacgccgacgauacagcagguugggacacucgcauaaccgaggaugaccugcagaacgaggcuaaaaucacggauauuauggaacccgagcacgcccuacuugcuaccuccaucuuuaagcugacauaucagaauaaagugguaagaguucagcggccugccaagaacgggacugugauggacgucauuagcaggcgugaucaacgaggaucuggccaggugggcaccuacgggcucaacacauucacuaauauggaagugcagcugauccgccagauggagucggaaggaauauuuuugccaucagaguuagagacccccaaccuggcagaaagaguccucgacuggcuugagaagcauggugcggaacggcugaaaaggauggccaucagcggcgacgauuguguugugaagccgauugacgaucgcuucgcuacggcccuaacagcacugaaugacauggggaaaguaagaaaggauaucccucaaugggagcccuccaaaggauggaacgacuggcagcaggugccauuuugcagucaccacuuccaucagcucauuaugaaggauggccgggaaaucgucgugccuuguaggaaucaagacgaguugguuggucgagcucgugugucucagggggccggauggagccugagagagaccgcaugccuuggcaaguccuaugcccagauguggcaacugauguacuuucaccgccgggaucucagguuagcggcuaacgccauauguucagcaguccccguggaauggguaccaacuaguagaacaaccuggucuauucaugcccaccaccaguggaugacuaccgaggacaugcugagcguuuggaaucgcguguggaucgaagagaaccccuggauggaagauaaaacacaugucuccucaugggaggaggugccuuauuugggcaagcgggaagaccaguggugcgggagccugaucggacucacggcuagggccaccugggcaacuaauauucagguugcuauaaaccaagugcgaagacuuaucgguaaugagaacuaccuggacuacaugacaucuaugaaacgguucaagaaugaauccgauccagagggcgcccuaugguga

SEQ ID NO: 13246 - RNA, 9879 nt, Artificial Sequence
  derived and/or modified CDS sequence (opt3) from DENV-1__GQ868568__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugugaucggcacaucgauuacccagaagggcaucauauucaucuuacugaugcuugucacgccaucaauggcuaugcgcugcguggggauuggaaacagagauuuuguagaggguuugagcggcgccacuuggguugacgugguccuggagcacgggaguugugugacaaccauggcgaagaauaaacccacucuagauaucgaacuccugaagacagaggugaccaacccugcaguccuuaggaaacugugcauugaagccaagaucuccaauacgaccacagacucucgguguccaacucaaggagaggcuaccuugguugaagagcaggaugccaacuucgugugccgccgaacauuuguagacagaggcugggguaauggguguggacucuucggcaaaggcagccuguuaacuugcgcaaaguuuaagugcgugaccaaacuggaggggaagauaguccaguacgaaaaccucaaauauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaaggacuggacuagauuucaacgaaauggugcugcucacaaugaaggagaaaagcuggcugguacauaagcagugguuucuugaccugccguugcccuggacgucuggcgccuccaccucacaagagacuuggaaucggcaggaucuccugguuacauucaaaaccgcacacgcuaagaagcaggaaguggucguguuagguagccaagagggggccaugcacacagcucugacuggcgccaccgaaauccagacgaguggaaccacaacuauuuuugcaggccaucuaaaaugccgucucaagauggacaaacugacccuuaaggggaugucuuaugucauguguacaggauccuucaaauuggagaaggaaguggccgagacucagcacgguaccguucuggugcagguaaaguacgagggcacggaugcuccuugcaaaauaccauucagcacacaagacgaaaagggggucacccagaacggacgccucaucacugcgaaucccauugugacagauaaagagaagccuguuaacaucgaaaccgagccacccuuuggcgagucguauauaguggucggugcaggggaaaaagcccugaagcuuucuugguucaagaaaggcuccucaauuggaaagauguuugaggcuacugccagaggcgcaaggcggauggccauccugggggacaccgcuugggauuucggaaguaucgguggcguguuuacaagcguagggaaauuggugcaucagguuuucggaacggccuacggcguccucuuuuccggugugucuuggauuaugaagaucgggauuggcauacuguuaaccuggcugggacuaaauagccgaucaacuagucucuccaugacauguaucgcagugggcauggucacccuguaccuugggguuauggugcaggcggacagcggaugcgugauuaacuggaaaggccgcgaauugaagugugguucugggaucuucguaacaaacgagguccacacuuggaccgaacaauauaaguuucaggcugauucaccgaaaagacugagugccgcaaucggaaaggccugggaggagggcgugugcgguauuaggagcgcuacgcggcucgaaaauauaauguggaaacagaucuccaacgagcugaaucauauuuuacuggaaaacgacaugaaguucacaguuguggucggcgacgccaaugggauccuugcacagggaaaaaagaugauucgcccucaacccauggagcacaaauacucuuggaagucguggggcaaggcuaaaaucauaggggccgauacccagaacacuaccuuuaucauugacggaccagauacaccugaaugucccgacggccagagagcguggaauaucugggagguggaggauuaugguuucgggauuuuuacuaccaacaucugguugaagcucagggacagcuacacacagaugugcgaucaccgucugauguccgccgcuauaaaagacucaaaggcaguucaugccgauaugggauauuggauugaaagugagaaaaaugaaacguggaagcuagcucgggccucuuucaucgaggugaagaccuguacuuggccaaaaagccacacacugugguccaacggcguacucgaaucagagaugauuauccccaagauauacgguggcccuaucagccaacauaauuaucgaccaggguacuucacccagacugcaggaccguggcaccugggcaaacuugaguuggacuuugaucugugcgaagggacaaccgucgugguggacgagcacugcggaaacagaggccccucuuuaaggacgacuaccgucacagguaagauuauccaugaaugguguugccgcuccuguacccucccuccacugcgguucagaggggaggauggaugcugguacggcauggagauuaggcccguuaaagaaaaggaggaaaaucuugugcgcaguaugguaagcgcggguucuggcgagguggacuccuuuucacuggggaucuugugugucaguauaaugauugaagaggugaugcgaagccgguggucgcguaagaugcucaugacuggaacacuggccguuuuccuacugcucaucaugggccagcugaccuggaacgaccuuacaagauugugcaucauggugggggcuaaugccuccgauaggaugggaaugggcacuaccuaucuggcauuaauggcuacguuuaaaaugcgcccuauguucgccgucggucuccuguuucggagacuuacaucuagggaggugcugcuacucaccauugggcugagcuugguugcaucaguggaacugccaaacaguuuagaggaacucggagacggccuggccaugggcaucaugaugcuuaagcuguugacugaguuccaaccccaccagcucuggaccacacugcuaucccugacuuuugucaaaaccacgcuuucucucgauuacgcuuggaagacaaccgcgaugguacugagcauuguguccuuguucccgcuguguuuaucaacuacaagccagaaaaccacuuggcucccuguucugcuugggaguuuuggaugcaagccacugacaauguucuugauaaccgaaaacaagaucuggggucgaaaaucuuggccccucaaugagggcauuauggccaucgggauuguguccauccugcuaagcucgcugcuuaagaacgacgucccucucgcaggaccccugauagcuggcgguauguugaucgccuguuaugugauuucagggucuagugccgauuuaucccuggagaaagcugcagaaguaagcugggagcaggaagccgagcauucuggagcgagccacaauauccucguggaaguccaagacgauggcacgaugaagauuaaagacgaggagcgcgaugacacucugaccauccuucugaaggcuacauugcuagccguuuccggcguguacccaaugucaauaccugcaacccuguuugugugguauuucuggcagaaaaagaagcagcggagugggguccucugggauacacccagcccaccggaaguggagagagccguucuggacgauggaauuuacaggauccuucagcgugguuuacugggccgcucucaaguaggggugggagucuuccaggacggcguguuucauacuauguggcacguuacccggggugcugugcucauguaucaggggaaaagauuggaaccuuccugggcaucagucaagaaagaccugaucaguuacggaggcggcuggagguuccaggggagcuggaacacgggagaggaggugcaaguaauugccgucgaacccgguaagaauccaaaaaacgugcagacaacucccggcaccuuuaagacaccugagggggaaguuggagcgauagcucucgauuucaagccaggcaccuccgguucucccaucgugaaucgagaggggaaaauugucggacuguacggcaacggcgugguuacuaccucggggacauaugugagcgccaucgcacaggccaaggcuucacaagaaggaccucuuccggagauugaggacgaagucuuuaaaaagcggaaucugacgaucauggauuugcacccagguuccggcaaaacucgcagauaccuacccgccauagugagggaggcaaucaagcggaagcugcgaacccucauuuuagcuccuacaagaguaguggccagugaaauggcggaggcccugaaagggaugccaauccgcuaucagaccacugcaguuaagucugaacauacaggaagggagauugucgaccuuaugugccacgcuaccuucacgaugcgucugcucagccccgugcgggugccuaacuacaauaugaucauaauggaugaggcccauuuuacugacccggcuuccauugcagccagaggcuauaucucaacaagggucgguaugggggaagccgcugcgaucuucaugaccgcaacccccccaggaucuguagaggccuuuccucagagcaacgcugugauucaggaugaagagcgcgacauccccgaacgaaguuggaauuccggcuacgauuggauaacugacuucccaggcaaaacaguuugguuugugccuagcauuaagucugggaacgauaucgccaauuguuugagaaaaaacggaaagcgggucauucaacugucaaggaagaccuucgacacagaguaucagaaaacuaagaacaaugacugggauuacgugguuacgaccgacaucuccgagaugggugcaaacuuccgcgccgaucgugugauagaccccagacggugccucaaaccagucauucugaaggauggcccggaaagggugauccuugcugggccuaugcccguaacaguggcgagugccgcacagcgccgaggaagaaucggccggaaucagaacaaagagggugaccaauacguuuauauggggcagccacuaaauaacgaugaagaccacgcucauuggacugaggccaagaugcuguuggauaauauuaacacccccgagggcaucauuccugcauuauuugaaccagagagggaaaagagcgccgcugucgacggagaguaccgccugagaggcgaagccaggaaaacauucguggagcucaugcggcguggggaucugcccguguggcuuucguauaaggucgcgucugagggauuucaguacuccgaccgccgauggugcuucgauggugaaagaaauaaccagguucuggaggaaaauauggacguggagauauggaccaaagaaggcgagaggaagaaacuccggccucgcugguuggacgcaagaacuuauagcgauccgcuggcccuaagggaguuuaaggaauucgcugccgggcggcgaucaguaaguggagaccugauccucgagauuggcaaacuuccacaacaccugacguuaagagcucagaacgcauuggauaaucuggugaugcuccacaacucugaacagggugggaaggccuaccgccaugcuauggaggaacugcccgacaccaucgagacacuuaugcugcucgccuugaucgcaguccugacuggcggagugaccuuauuuuuccuauccggcaaggggcugggaaaaacaagcauuggucuccuuuguguuaccgcgucaagugcccuguuguggauggcuagcguggagccucacuggauagccgcauccaucauucuggaauuuuuccucaugguccugcuuauccccgagccagauaggcagcggacuccucaagacaaucagcucgcuuauguagugauuggccuguuguuuaugauccugacaguugccgcaaacgaaaugggguuacuagagacgaccaagaaagaucugggaauaggcuacguggccgcugagaaccaucagcacgcgacuaugcucgacgucgaucuucgucccgccucugcauggacacuguacgcuguggccaccaccgucaucacaccaaugaugagacacacuauugaaaauacgaccgccaacaucagcuugacagcaauugcuaaucaagccgcgauccugaugggucucgacaagggguggccuauauccaaaauggauauuggcgugccgcugcuugcuuuaggaugcuauucacagguuaacccccugacucucaccgccgcaguguugaugcugguagcccauuacgcuaucauuggcccagggcuacaggcaaaggccacaagggaggcgcagaagcgcaccgcugccggaaucaugaaaaauccuacuguggacggcauagucgcaaucgaucuggaccccguuguguaugacgccaaguucgaaaaacaacucggucagauuaugcuucugaucuuguguacgucucagauucugcucaugcggacaaccugggcucugugcgagaguaucacuuuagccaccgggccacuuacaacucugugggaaggaucgccuggcaaguuuuggaacaccacaauagcagucagcauggcuaauauuuuccgagguuccuaccucgccggcgcggggcuagccuucucucugaugaaaucauugggaggcgggagaaggggaacgggcgcacagggugagacccugggggagaaguggaagcgccaacucaaccagcuuagcaaauccgaauuuaauacuuauaagcggaguggaaucauggagguggauagaucugaagcuaaagagggccugaagcguggugaaacaaccaaacacgccguaagcaggggcacugcaaaguugcggugguucguggagcgcaaccugguuaagcccgaggggaaagugaucgaccucggauguggccgagggggauggucauacuauugcgcuggcuuaaagaaagucacagaagugaaggguuacaccaaagggggaccgggccaugaggaaccaauuccuauggccacguacggcuggaaucuggucaagcuucacuccgggaaagauguguuuuucaugcccccagagaagugugacacccugcuaugcgauaucggagaaaguagccccaacccuacaauagaggaggguagaacucucaggguucugaagaugguagaaccgugguugcggggcaaucaguuuuguauuaaaauccugaaccccuauaugccaucuguggucgagacccucgaacagaugcaacgcaagcaugggggaaugcuugugagaaauccucuguccaggaacucaacacacgagauguacuggguuagcugcggcacugguaauauugugucggccgucaacaugaccucucgaauguuacugaaccgguucacaauggcgcaccguaaacccaccuaugagagagacguggauuugggggcuggaacucgccauguagcaguggaaccugagguugccaaucucgacaucauaggccagaggaucgaaaacauuaagaaugagcacaaaaguacguggcauuacgaugaagacaacccauauaagacaugggcuuaccacggcuccuaugaggucaagcccagcgggucagccuccucuauggugaauggagugguccggcugcuaaccaaaccuugggauguuaucccaauggugacucagauugcaaugaccgacacaacgcccuuuggucaacagagaguauucaaggagaaaguggacacccgcacuccgagggccaagcgaggcacaacccagaucauggaagucacugcuaaauggcuuuggggguuucugagccggaacaagaagccuagaauuuguacaagggaggaauucacccgcaaagugcguaguaaugcggccaucggagcaguuuuuguggaugagaaccaguggaauuccgcuaaggaagccgucgaggacgagcgguucugggaucucgugcacagagaaagggagcugcauaaacaaggcaagugcgcaacaugcguauacaacaugauggguaaacgcgaaaagaaguugggggaguuuggaaaagccaagggcagccgagcuauaugguacauguggcugggcgcccgguuccucgaauucgaggcgcuuggguuuaugaaugaggaccacugguucucuagagaaaacucacugaguggaguugagggugaaggcuuacauaaacugggguauauuuugagggauaucuccaagaucccaggaggcaauauguacgcagacgauacugccgguugggacacccgcauuacggaggaugaccuccagaacgaggcuaaaauaaccgauaucauggaacccgagcacgcccugcuagcaacaagcauuuuuaagcuuacuuaucagaauaaaguggucagagugcagcggccugcuaagaacgggaccgugauggacgucaucucuaggcgugaucaacgaggaucgggccagguuggcacauacgggcugaacacuuucaccaauauggaagugcagcucauucgccagauggagucagaaggaaucuuucugccaagcgaguuggagacgcccaacuuagccgaaagaguacuggacuggcucgagaagcauggugcugaacggcuuaaaaggauggccauauccggcgacgauuguguggucaagccgaucgacgaucgcuucgcaacagcgcugaccgcccuaaaugacauggggaaagugagaaaggauauuccucaaugggagcccaguaaaggauggaacgacuggcagcagguuccauuuugcucucaccacuuccaucagcugaucaugaaggauggccgggaaauuguggucccuuguaggaaucaagacgagcucgugggucgagcucguguaagccagggggccggaugguccuugagagagacugcaugccugggcaagucauaugcucagauguggcaacuuauguacuuucaccgccgggaucugaggcucgccgcaaacgccaucuguagugcgguucccguggaaugggucccaacaucuagaaccacuuggagcauacaugcucaccaccaguggaugaccacagaggacauguuauccguguggaaucgcguuuggauugaagagaaccccuggauggaagauaaaacgcaugugucaagcugggaggaggucccuuaucugggcaagcgggaagaccaguggugcgggucuuugaucggacugaccgccagggcaacuugggccacaaauauccagguggcuauuaaccaaguacgaagacucauagguaaugagaacuaccuugacuacaugaccuccaugaaacgguucaagaaugaaagugauccagagggcgcccugugguga

SEQ ID NO: 13247 - RNA, 9879 nt, Artificial Sequence
  derived and/or modified CDS sequence (opt3) from DENV-1__GQ868569__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagagguggccaacccugcugugcuuaggaaacugugcauugaagccaagaucuccaauaccacgaccgacucucgguguccaacacaaggagaggcaacuuuggucgaagagcaggaugcuaacuucguuugccgccgaaccuuuguggacagaggcugggguaauggguguggacucuucggcaaaggcagccuguuaacaugcgccaaguuuaagugcguaacuaaacuggaggggaagauagugcaguacgaaaaccucaaauauuccgucauugugaccguucacacaggagaucagcaucaaguggguaaugagaccacugaacacggcacgaucgcgacaauuaccccccaggccccuacuucagagauccagcuuaccgacuacggggcacugacauuggacuguaguccaaggaccggacuagauuucaacgaaaugguccugcucacuaugaaggagaaaagcuggcuggugcauaagcagugguuucuugaccugccguugcccuggacaucuggcgcuuccacgucacaagagaccuggaaucggcaggaucuccugguaacuuucaaaacagcccacgcuaagaagcaggaaguuguggucuuagguagccaagagggggccaugcacaccgcacugacaggcgccacugaaauccagaccaguggaacgaccacaauuuuugcuggccaucuaaaaugccgucucaagauggacaaacugacucuuaaggggaugucuuaugugauguguaccggauccuucaaauuggagaaggaagucgcggagacacagcacgguacugugcugguucaggugaaguacgagggcaccgaugcaccuugcaaaauaccauucagcacgcaagacgaaaaggggguaacacagaacggacgccucaucaccgccaaucccauugucacugauaaagagaagccugugaacaucgaaacagagccacccuuuggcgagucguauauaguugugggugcuggggaaaaagcccugaagcuuucuugguucaagaaaggcuccucaauuggaaagauguuugaggcaaccgccagaggcgcuaggcggauggccauccugggggacacugcaugggauuucggaaguaucgguggcgucuuuaccagcguggggaaauugguacaucagguguucggaacagcguacggcguucucuuuuccggugucucuuggacgaugaagauugggaucggcauucuguuaaccuggcugggacuaaauagccgaucaacuagucucuccaugacauguauagcugugggcauggugacccuguaccuuggggucaugguucaggccgacagcggaugcgugaucaacuggaaaggccgcgaauugaagugugguucugggauuuucgugacaaacgagguacacacuuggaccgaacaauauaaguuucaggcagauucaccgaaaagacugagugccgcuaucggaaaggccugggaggagggcgucugcgguaucaggagcgcaacgcggcucgaaaauauuauguggaaacagauauccaacgagcugaaucauaucuuacuggaaaacgacaugaaguucacagugguugugggcgacgcuaaugggauucuugcccagggaaaaaagaugauccgcccucaacccauggagcacaaauacucuuggaagucguggggcaaggcgaaaauuaucggggccgauauacagaacgcuaccuuuaucauugacggaccagauacuccugaaugucccgacggccagagagcauggaauaucugggaggucgaggauuaugguuucgggauuuuuaccacaaacaucugguugaagcucagggacagcuacacucagaugugcgaucaccgucugauguccgccgcuauaaaagacucaaaggccgugcaugcagauaugggauauuggauugaaagugagaaaaaugaaaccuggaagcuagcgcgggccucuuucaucgagguuaagacauguacguggccaaaaagccacacccugugguccaacggcgugcucgaaucagagaugauuauccccaagauauacgguggcccuaucagccaacauaauuaucgaccaggguacuucacucagacagcuggaccguggcaccugggcaaacuugaguuggacuuugaucugugcgaagggaccacuguagucguggacgagcacugcggaaacagaggccccucuuuaaggacaaccacggugacugguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacaggaacccuggcaguguuccuacugcucaucaugggccagcugacuuggaacgaccuuacaagauugugcaucaugguuggggcuaaugccuccgauaggaugggaaugggcaccacauaucuggcauuaauggccacuuuuaaaaugcgcccuauguucgcugugggucuccuguuucggagacuuaccucuagggagguccugcuacucacgauugggcugagcuugguggcgucaguugaacugccaaacaguuuagaggaacucggagacggccuggccaugggcaucaugaugcuuaagcuguugacagaguuccaaccccaccagcucuggaccacucugcuaucccugaccuuugugaaaacaacucuuucucucgauuacgcauggaagaccacggcuaugguccugagcauuguauccuuguucccgcuguguuuaucaacaaccagccagaaaacuacauggcucccugugcugcuugggaguuuuggaugcaagccacugaccauguucuugauaacugaaaacaagaucuggggucgaaaaucuuggccccucaaugagggcauuauggccaucgggauuguuuccauccugcuaagcucgcugcuuaagaacgacgugccucucgccggaccccugauagcuggcgguauguugaucgcauguuaugucauuucagggucuagugccgauuuaucccuggagaaagcggcugaagugagcugggagcaggaagccgagcauucuggagcaagccacaauauccucguagaagugcaagacgauggcacaaugaagauuaaagacgaggagcgcgaugacacccugacgauccuucugaaggccacuuugcuagcugucuccggcguuuacccaaugucaauaccugcaacccuguuugugugguauuucuggcagaaaaagaagcagcggaguggggugcucugggauacacccagcccaccggaagucgagagagccgugcuggacgauggaauuuacaggauccuucagcgugguuuacugggccgcucucaaguugggguaggaguguuccaggacggcgucuuucauaccauguggcacgugacacggggugcgguucucauguaucaggggaaaagauuggaaccuuccugggcuucagugaagaaagaccugaucaguuacggaggcggcuggagguuccaggggcucuggaacaugggagaggagguccaagugauugccguagaacccgguaagaauccacgaaacguccagacuacccccggcacguuuaaaacaccugagggggaagugggagcaauagcccuggauuucaagccaggcacuagcgguucccccaucguuaaucgggaggggaagauugugggacuuuacggcaacggcgucgugaccacaucugggaccuauguuucggcuaucgcccaggcaaaagcuagccaagaaggaccucugccggagauugaggacgaaguguuuaagaaacgcaauuugacuaucauggaucuacacccagguucaggcaagaccagaagguaccugcccgccauaguccgggaggcgaucaaacgaaagcucagaacauuaauucuggccccuacgcgcgugguagcauccgaaauggcugaggcccuuaaggggaugccaaucagguaucagacuaccgcugugaaaagugaacauacaggacgugagauuguugaccugaugugccacgcaaccuucacuaugcggcucuugucucccgucagagugccuaacuacaauaugaucauaauggaugaggcccauuuuacagacccggccagcauugcugcgaggggcuauaucuccacccgcguggguaugggggaagcagccgcuaucuucaugacggccacucccccaggaucagucgaggcauuuccucagucuaacgccguaauucaggaugaagagcgagacauccccgaaagaagcuggaauaguggcuacgauuggauaacagacuucccaggcaagaccgugugguuuguuccuuccauuaaaagcgggaacgauaucgcuaauugucugcggaagaacggaaaaagggugauucaacucucucgcaagaccuucgacacugaguaucagaagacaaaaaacaaugacugggauuacgucgugaccacagacaucucagagaugggugcgaacuuccgugccgauagaguuauagacccccggaggugccugaagccagugauucuuaaagauggcccggaacgcgucauccuagcagggccuaugcccgugacuguagcuuccgccgcacagcgaagaggacggaucggcaggaaucagaacaaggagggugaccaauacguguauauggggcagccacugaauaacgaugaagaccacgcccauuggacggaggcuaaaauguuguuagauaauauuaacacccccgagggcaucauuccugcccuguuugaaccagagcgcgaaaagagugcggcaauagacggagaguacagacucaggggcgaagcccggaagacauucguugagcugaugcgucgcggggaucuucccgucuggcugagcuauaaaguggcuucggagggauuucaguacucugaccgaagauggugcuucgauggugaaaggaauaaccaggugcucgaggaaaauauggacgucgagaucuggacuaaggaaggcgagcggaaaaaguugcgcccuagauggcuggacgccaggaccuauuccgauccgcuagcucugcgggaguuuaaagaauucgcagccgggcgaagaagcguuucaggagaccucauucuugagaucggcaagcugccacaacacuuaacauugcgcgcucagaacgcccuggauaaucucgugaugcugcacaacagugaacagggugggaaagcauacaggcaugcgauggaggaacuucccgacaccaucgagacucugaugcucuuggcccugauugcuguauuaacgggcggagugacccuauuuuuccugucuggcaaggggcucggaaagacauccauaggucuucugugugucacugccagcucagcauugcuguggauggcuaguguggagccucacuggaucgccgcaagcauuauccucgaauuuuuccugaugguucuucucauucccgagccagaucggcagcguaccccucaagacaaucagcuggccuauguggucaucggcuugcuguuuaugauauuaacaguagcugcgaacgaaauggggcuacuggagaccacuaaaaaggaucucggaaucggcuacgccgcagcugagaaccaucagcacgccacaaugcuugacguggaucugagacccgccuccgcauggacguuguacgcuguugccaccacugugauuacaccaaugaugaggcacaccaucgaaaauaccacagcgaacauuucucugacugcuaucgccaaucaagcagccauacucaugggucuggacaaaggguggccuauuagcaagauggauaucggcgucccgcuuuuagcucugggaugcuauucccaggugaacccccucacguugaccgcagccguccugaugcuaguggcgcauuacgcuauuaucggcccagggcugcaggccaaagcaacacgcgaggcccagaagcggacugcugccggaauaaugaagaauccuaccguugacggcaucguggcaauugaucucgaccccguaguguaugacgcuaaauucgaaaagcaacuuggucagaucaugcuguugauucuguguacaucacagauccuccugaugcgaaccacuugggccuuaugcgagucuauaacgcuugcgacagggccacugaccacucucugggaaggaaguccuggcaaauuuuggaacaccacaauugccgucucgauggcaaauaucuucagagguagcuaccuagcuggcgccgggcuggcauucuccuugaugaagucucugggaggcgggaggcgcggaacuggcgcucagggugagacccucggggagaaauggaagcggcaacuuaaccagcugucaaagagcgaauuuaauacauauaaaagauccggaaucauggagguugaucguagugaagccaaggagggcuugaaaaggggugaaacgaccaagcacgccgugucucggggcacugcgaaacugcgcugguucgucgagcgaaaccucgugaagcccgaggggaagguaauugacuuaggauguggcagagggggauggagcuacuauugcgcuggccugaaaaaggugacagaaguuaaagguuacaccaaggggggaccgggccaugaggaaccaaucccuauggcaacuuacggcuggaaucuugugaaacugcacucagggaaggaugucuuuuucaugcccccagagaaaugugacacacuacucugcgauauaggagaauccagucccaacccuaccauugaggaggguaggacgcugcggguguugaagauggucgaaccguggcugcgcggcaaucaguuuuguaucaagauucucaaccccuauaugccaagcgugguugagacccuugaacagaugcaaagaaaacaugggggaaugcugguaaggaauccuuuaucucgaaacuccacacacgagauguacugggugucaugcggcacugguaauaucgucagcgccgugaacaugaccucgcggaugcuguugaaccguuucacaauggcucacagaaagcccacuuaugagcgcgacguugaucucggggccggaaccaggcauguggcagucgaaccugagguggccaaucuggacauaaucggccagcggauugaaaacaucaaaaaugagcacaagucuacauggcauuacgaugaagacaacccauauaaaaccugggcuuaccacggcaguuaugagguaaagcccuccgggagcgcgucauccauggugaauggaguugucagacuacuuacuaagccuugggaugugauuccaauggugacgcagaucgccaugacagacaccacucccuuuggucaacagcgcgucuucaaagagaagguugacaccaggacaccgcgagcaaaacggggcacgacccagauuauggaagugacugcuaaguggcuguggggguuucucucuagaaacaaaaagccuaggaucuguacacgcgaggaauucacccguaagguacggagcaaugccgcaauaggagccguguuugucgaugagaaccaguggaauagugcuaaagaagccguggaggacgagagauucugggaucugguucacagggaacgcgaguugcauaagcaaggcaaaugcgcgacuugcguguacaacaugauggguaagcgagaaaaaaagcugggggaguuuggaaaggcaaaaggcucccgggccauuugguacauguggcucggcgcuagauuccuugaauucgaggcccugggguuuaugaaugaggaccacugguucagcagggaaaacucuuuaucaggagucgagggugaaggccugcauaaguugggguauauccuccgcgauaucaguaaaauuccaggaggcaauauguacgcagacgauacagcugguugggacaccagaauaacagaggaugaccugcagaacgaggccaagaucacugauauuauggaacccgagcacgcucuacuugccaccuccaucuuuaaacugacguaucagaauaaggugguacggguucagaggccugcaaaaaacgggaccgugauggacgucauuagccgucgagaucaacgcggaucuggccaggugggcacauacgggcucaacacuuucaccaauauggaagugcagcugaucagacagauggagucggaaggaauauuuuugccaucagaguuagagacacccaaccuggcggaacggguccucgacuggcuugagaagcauggugccgaaaggcugaagcgcauggcuaucagcggcgacgauuguguugugaaaccgauugacgauagauucgccacugcacuaaccgcucugaaugacauggggaagguacggaaagauaucccucaaugggagcccuccaagggauggaacgacuggcagcaggugccauuuugcagucaccacuuccaucagcucauuaugaaagauggcagggaaaucgucgugccuugucgaaaucaagacgaguugguuggucgugccagagugucucagggggcaggauggagccugcgcgagacggccugccuuggcaaguccuaugcgcagauguggcaacugauguacuuucaccggagggaucucagauuagcugccaacgcaauauguucagccguccccguggaauggguaccaacaagucgcaccacuuggucuauucaugcucaccaccaguggaugacaaccgaggacaugcugagcguuuggaaucggguguggaucgaagagaaccccuggauggaagauaagacucaugucuccucaugggaggaggugccuuauuugggcaaaagggaagaccaguggugcgggagccugaucggacucaccgcccgagcaacaugggcuacgaauauucagguugccauaaaccaagugagacggcuuaucgguaaugagaacuaccuggacuacaugaccucuaugaagagguucaaaaaugaauccgauccagagggcgcgcuaugguga

SEQ ID NO: 13248 - RNA, 9879 nt, Artificial Sequence
  derived and/or modified CDS sequence (opt3) from DENV-1__GQ868570__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagguggggauuggcauccuguuaacuuggcugggacuaaauagccgaucaacaagucucuccaugaccuguauugcggugggcauggucacacuguaccuugggguuauggugcaggcugacuugggaugcgugauaaacuggaaaggccgcgaacugaagugugguagcgggaucuucguaacuaacgagguccacaccuggacggaacaauauaaguuucaggccgauucuccgaaaagacucucagcagccauuggaaaggcuugggaggagggcgugugcgguaucaggaguguuacacggcuggaaaauaucauguggaaacagauuagcaacgaguuaaaucauauacugcuugaaaacgacaugaaguucaccguggucgugggcgacgccaaugggaucuuggcacagggaaaaaagaugauucgcccucaacccauggagcacaaauacuccuggaagucuuggggcaaggcuaaaaucauuggggccgauacucagaacaccacauuuaucauagacggaccagauacuccugaaugucccgacggccagagagcguggaauaucugggagguugaggauuaugguuucgggauuuuuaccacaaacaucuggcucaagcugagggacucguacacgcagaugugcgaucaccgucuaaugagcgccgcuauuaaagacuccaaggcagugcaugccgauaugggauauuggaucgaaucagagaaaaaugaaaccuggaagcuggcucgggccaguuucauagagguaaagacuuguacauggccaaaaucucacacccucuggagcaacggcguccuggaauccgagaugauuauccccaagauuuacgguggcccuaucucacaacauaauuaucgaccaggguacuucacucagacagcaggaccguggcaccuuggcaaauuggagcuggacuuugauuuaugcgaagggaccacggugguggucgacgagcacugcggaaacagaggccccagccucaggacuaccacaguuaccgguaagauaauccaugaaugguguugccgcucuuguacucugccuccacuucgguucagaggggaggauggaugcugguacggcauggagauuaggcccgugaaagaaaaggaggaaaaucugguacgcuccauggugagugcggguagcggcgaggucgacucuuuuuccuuggggauccucugugugucaauuaugaucgaagagguuaugcgaagucgguggagccguaagaugcugaugacaggaacccuagccguguuccugcuccugauaaugggccagcuuacauggaacgacuugauuagacugugcaucauggucggggcuaaugccucggauaggaugggaaugggcacuaccuauuuagcacucauggcuacguuuaaaaugcgcccuauguucgccgugggucugcuuuuucggagacugacauccagggagguucuacuccugaccaucggguugucucugguggcaagcgucgaauuaccaaacucacucgaggaacugggagacggccuugccaugggcauuaugaugcugaaguugcucacugaguuccaaccccaccagcuguggaccacacuacugagucuuacuuuuguaaaaaccacgcucucccuggauuacgcuuggaagacaaccgcgaugguguugucuaucguuagccuguucccguuaugucucuccacuacaucacagaaaaccacuuggcugccugugcuucuggggagcuuuggaugcaagccauugacaauguuccucauuaccgaaaacaagauauggggucgaaaaaguuggccccugaaugagggcaucauggccauugggaucgucucuauucuacuguccagccuucucaagaacgacgugccucuggcaggacccuugaucgcuggcgguauguuaauagccuguuauguaaucucggggucaucugccgaucugagucucgagaaagcugcagaaguguccugggagcaggaagccgagcauagcggagcgucucacaauauucuggucgaaguucaagacgauggcacgaugaagaucaaagacgaggagcgcgaugacacucuuaccauucuguugaaggcuacacuacuggccgugagcggcguguacccaauguccaucccugcaacccucuuugucugguauuucuggcagaaaaagaagcagcggucaggggugcugugggauacacccaguccaccggaaguugagagagccguacuugacgauggaauauacaggauuuuacagcguggucugcucggccgcagccaagugggggucggaguguuccaggacggcguuuuucauacuauguggcacgugacccggggugcugucuugauguaucaggggaaaagacuggaaccuucuugggcauccgugaagaaagaccucaucucauacggaggcggcuggagguuccaggggaguuggaacacgggagaggagguacaagucaucgccguggaacccgguaagaauccaaaaaacguucagacaacucccggcaccuuuaagacaccugagggggaagugggagcgauugcucuggauuucaagccaggcaccagcgguucccccauagucaaucgagaggggaaaaucgugggacuuuacggcaacggcguugugacuaccucugggacauaugucucggccauugcacaggccaaggcuagccaagaaggaccucugccggagaucgaggacgaaguguuuaaaaagcggaauuugacgauuauggaucuacacccagguucaggcaaaacucgcagauaccugcccgccaucguaagggaggcaauaaagcggaagcuccgaaccuuaauccuggcuccuacaagagugguugccuccgaaauggcggaggcccuuaaagggaugccaauucgcuaucagaccacugcagucaagagugaacauacaggaagggagaucguggaccugaugugccacgcuaccuucacgaugcgucucuugucucccgugcgggucccuaacuacaauaugauuaucauggaugaggcccauuuuacugacccggcuagcauagcagccagaggcuauauuuccacaaggguagguaugggggaagccgcugcgaucuucaugaccgcaacccccccaggaucaguggaggccuuuccucagucuaacgcuguuauccaggaugaagagcgcgacauucccgaacgaagcuggaauaguggcuacgauuggaucacugacuucccaggcaaaacagugugguuugucccuuccauaaagagcgggaacgauauugccaauugucugagaaaaaacggaaagcgggugauccaacucucuaggaagaccuucgacacagaguaucagaaaacuaagaacaaugacugggauuacguugugacgaccgacauuucagagaugggugcaaacuuccgcgccgaucgugucaucgaccccagacggugccugaaaccagugauacuuaaggauggcccggaaaggguaauucuagcugggccuaugcccgugacaguugcguccgccgcacagcgccgaggaagaaucggccggaaucagaacaaagagggugaccaauacgucuauauggggcagccacugaauaacgaugaagaccacgcucauuggacugaggccaagauguuguuagauaauaucaacacccccgagggcauuaucccugcacuguuugaaccagagagggaaaagagugccgcuauugacggagaguaccgccucagaggcgaagccaggaaaacauucguggagcugaugcggcguggggaucuucccguguggcugagcuauaaggucgcgucggagggauuucaguacucugaccgccgauggugcuucgauggugaaagaaauaaccagguucucgaggaaaauauggacguggagauauggaccaaagaaggcgagaggaagaaauugcggccucgcuggcuggacgcaagaacuuauuccgauccgcuagcccugagggaguuuaaggaauucgcugccgggcggcgaagcguaucaggagaccucauccuugagauuggcaaacugccacaacacuuaacguugagagcucagaacgcacuggauaaucucgugaugcugcacaacagugaacagggugggaaggccuaccgccaugcuauggaggaacuucccgacaccaucgagacacugaugcucuuggcccugaucgcagucuuaacuggcggagugacccuauuuuuccugucuggcaaggggcucggaaaaacauccauuggucuucuguguguuaccgcgagcucagccuugcuguggauggcuaguguggagccucacuggauagccgcaagcaucauucucgaauuuuuccugaugguccuucucauccccgagccagauaagcagaggacuccucaagacaaucagcuggcuuauguagugauuggcuugcuguuuaugaucuuagccguugcagccaacgaaauggggcuacuggagacaacgaaaaaggaucucggaauaggcuacguggcuaccgagaaccaucagcacgcgacuaugcuugacgucgaucugcggcccgccuccgcauggacauuguacgcuguggccaccaccgucaucacaccaaugaugcgucacacuauugaaaauacgaccgccaacaucucucugacagcaauugcuaaucaagccgcgauccucaugggucuggacaaaggguggccuauaagcaagauggauauuggcgugccgcuuuuagcucugggaugcuauucccagguuaacccccucacuuugaccgccgcagugcugaugcuaguagcccauuacgcuaucauuggcccagggcugcaggcaaaggccacaagagaggcgcagaaaaggaccgcugccggaaucaugaagaauccuacuguggacggcauagucgcaaucgaucucgaccccguuguguaugacgccaaauucgaaaagcaacuuggucagauuaugcuguugauccuguguacgucacagauucuccugaugcgcacaaccugggcuuuaugcgagucuaucacucuugccaccgggccacugacaacucucugggaaggaaguccuggcaaauuuuggaacaccacaauagcagucucgauggcuaauauuuuccgggguagcuaccuagccggcgcggggcuggccuucuccuugaugaagucucugggaggcgggcgaagaggaacgggcgcacagggugagacccucggggagaaguggaaaaggcaacuuaaccagcugucaaagagcgaauuuaauaucuauaaacgcuccggaaucauggagguggaucggagugaagcuaaggagggcuugaaaagaggugaaacuacaaagcacgccguaucucguggcaccgcaaagcugaggugguucguggagcggaaccucguuaaacccgaggggaaggugauugacuuaggauguggccgcgggggauggagcuacuauugcgcuggccugaaaaaggucacugaagugaaagguuacacaaaggggggaccgggccaugaggaaccaaucccuauggccaccuacggcuggaaucuugucaaacugcacucagggaaggauguguuuuucaugcccccagagaagugugacacgcuacucugcgauauaggagaauccagucccaacccuaccauugaggagggucgaacacugagaguuuugaaaaugguagaaccguggcugaggggcaaucaguuuuguaucaagauucucaaccccuauaugccaagcguggucgagacucuugaacagaugcaacggaaacaugggggaaugcuggugcgcaauccuuuaucuagaaacuccacccacgagauguacuggguuucaugcggcacagguaauaucgugagcgccgucaacaugacuucgaggaugcuguugaaccgauucaccauggcgcaccggaagcccacauaugagcgugacguggaucucggggcuggaaccagacauguagcaguggaaccugagguugccaaucuggacauaaucggccagcgcauugaaaacaucaaaaaugagcacaagucuacuuggcauuacgaugaagacaacccauauaagacgugggcuuaccacggcaguuaugaggucaaacccuccgggagcgccucauccauggugaauggaguggucaggcuacuuacaaagccuugggauguuauuccaauggugacccagaucgcaaugacugacaccacacccuuuggucaacagcggguauucaaagagaagguggacacgagaaccccgcgcgccaaaaggggcacuacacagauuauggaagucaccgcuaaguggcuguggggguuucucucucgaaacaagaaaccucggaucuguacuagagaggaauucacaaggaaggugcgcagcaaugcggccauaggagcaguuuuuguggaugagaaccaguggaauagugcuaaagaagccgucgaggacgagcguuucugggaucuggugcaccgggaaagagaguugcauaagcaaggcaaaugcgcaaccugcguauacaacaugauggguaagagggaaaagaaacugggggaguuuggaaaggccaaaggcucccgcgcuauuugguacauguggcucggcgcccgauuccuugaauucgaggcgcugggguuuaugaaugaggaccacugguucagccgggaaaacucuuuaucaggaguugagggugaaggccugcauaaguugggguauauccucagagauaucaguaaaauuccaggaggcaauauguacgcagacgauacagccgguugggacacuaggauaaccgaggaugaccugcagaacgaggcuaagaucacggauauuauggaacccgagcacgcccuacuugcaaccuccaucuuuaaacugacauaucagaauaaggugguccgcgugcagagaccugcuaagaacgggacugugauggacgucauuagccggagggaucaacguggaucuggccagguuggcaccuacgggcucaacacauucacuaauauggaagugcagcugauccgacagauggagucggaaggaauauuuuugccaucagaguuagagacccccaaccuggccgaacgcguacucgacuggcuugagaaacauggugcugaaagacugaagcggauggccaucagcggcgacgauuguguggucaaaccgauugacgauagguucgcagcggcccuaacggcucugaaugacauggggaaggugcgcaaagauaucccucaaugggagcccuccaagggauggaacgacuggcagcagguuccauuuugcagucaccacuuccaucagcucauuaugaaggauggcagagaaaucguggucccuugucggaaucaagacgaguugguggguagggcccgaguaucucagggggcaggauggagccugcgugagacagcuugccuuggcaaauccuaugcccagauguggcaacugauguacuuucacagacgcgaucuccgguuagcagccaacgcgauauguucagcuguucccguggacugggucccaaccaguaggacuacauggucuauucaugcccaccaccaguggaugaccacugaagauaugcugagcguguggaauagaguuuggaucgaggaaaaccccuggauggaggacaagacccauguguccucaugggaagaggucccuuauuugggcaaacgcgaggaccaguggugcgggagccugaucggacucacagcacgggccacgugggcuaccaauauucagguggccauaaaccaaguaaggcgacuuaucgguaaugaaaacuaccuggauuacaugacuucuaugaagagauucaaaaaugaguccgacccagaaggcgcacuaugguga

SEQ ID NO: 13249 - RNA, 9879 nt, Artificial Sequence
  derived and/or modified CDS sequence (opt3) from DENV-1__KJ189302__SS-prME
agcgugaccaugcugcucaugcuucugcccacugccuuggcuuuccacuuaacuacgagaggaggggagccucauaugaucgucuccaagcaggaaagaggaaaaucucugcuauuuaagaccucagcugguguuaacaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcuccccaugucggcuugggucucgagacuagaaccgaaacauggauguccucugagggggccuggaaacagauccagaggguggaaacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagauuucguggagggucuuagcggcgcgacuuggguagacguuguguuggagcacgggaguugugucacaaccauggcaaagaauaaacccacucuggauaucgaacuacucaagacagaggugaccaacccugccgugcugaggaaacuuugcauugaagcuaagaucuccaauacgaccacagacucucgguguccaacucaaggagaggccacccuggucgaagaacaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaaggacuggauuggauuuuaacgaaaugguccuacugacaaugaaggagaaaagcuggcucgugcauaagcagugguuccuggaccuuccgcugcccuggacgucuggcgcauccaccucacaagagacuuggaaucggcaggauuugcucguaacauuuaaaaccgcucacgccaagaagcaggaaguugugguccuggguagccaagagggggcuaugcacacagccuuaacuggcgcaaccgaaauccagacgaguggaaccacaacuauuuucgccggccaucugaaaugccgucuaaagauggacaaacucacccugaaggggaugucuuaugugauguguacaggauccuucaaacuugagaaggaagucgcugagacucagcacgguaccguguugguucaggugaaguacgagggcacggaugcgccuugcaaaauaccauuuagcacacaagacgaaaaggggguaacccagaacggacgccugaucacugcaaaucccauugucacagauaaagagaagccugugaacaucgaaaccgagccacccuucggcgagucguauauaguugugggugccggggaaaaagcucucaagcugucuugguuuaagaaaggcuccucaauuggaaagauguucgaggccacugcaagaggcgccaggcggauggcuauccuuggggacaccgccugggauuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagccgaucaacaagucuauccaugaccuguauagcggugggcauggugacacucuaccugggggucaugguucaggcugacagcggaugcgugaucaacuggaaaggccgcgaacuuaagugugguucugggauuuuugugacuaacgagguacacaccuggacggaacaauauaaguuccaggccgauucaccgaaaagauugagugcagccaucggaaaggcuugggaggagggcgucugcgguaucaggagcgccacacggcuggaaaauauuauguggaaacagauauccaacgagcucaaucauauccuguuagaaaacgacaugaaguuuaccgugguugugggcgacgcaaaugggauucuggcucagggcaagaagaugauccgcccucaacccauggagcacaaauacucuuggaagucguggggcaaggccaaaauuaucggggcggauauacagaacacuaccuucaucauugacggaccagauacaccugaaugucccgacggccagagagccuggaauaucugggaggucgaggauuaugguuuugggauuuucacuaccaacaucuggcuuaaguugagggacagcuacacacagaugugcgaucaccgucucauguccgcugcaauaaaagacucaaaggccgugcaugcugauaugggauauuggauugaaagugagaaaaaugaaacguggaagcuggcccgggcaucuuucaucgagguuaagaccuguacuuggccaaaaagccacacacuaugguccaacggcgugcuggaaucagagaugauuauccccaagauauacgguggcccuaucagccaacauaauuaucgaccaggguacuuuacccagacugcgggaccguggcaccucggcaaacuggagcuugacuucgauuugugcgaagggacaaccguagucguggacgagcacugcggaaacagaggccccucucugaggacgacuaccgugacagguaagauuauccaugaaugguguugccgcuccuguaccuuaccuccacuccgguuuagaggggaggauggaugcugguacggcauggagauuaggcccgucaaagaaaaggaggaaaaucugguucgcaguauggugagcgccgguucuggcgagguagacuccuucucacuugggauccugugugugaguauaaugauugaagaggucaugcgaagccgguggucgcguaagauguugaugacuggaacacucgcuguguuucugcuacugaucaugggccagcucaccuggaacgaccugaucagacuuugcauuaugguuggggccaaugcauccgauaggaugggaaugggcacaacuuauuuggcucugauggccaccuucaaaaugcgcccuauguuugcaguggguuuacucuuccggagacugacgucuagggagguccuucugcuaacaaucgggcucagccugguggccucaguugaauugccaaacagucuggaggaauuaggagacggccucgcuaugggcauuaugaugcugaaacuucugaccgaguuucaaccccaccaguuguggacuacccuccugucccuaacauucgugaaaacuacccugucucuugauuacgcguggaagacgacagccaugguccucagcauaguaucccuguuuccguugugucugucaaccacuagccagaaaacaaccugguuaccugugcuccuggggaguuucggaugcaagccacuuacuauguuucugaucacagaaaacaagauuuggggucgaaaaucuuggcccuugaaugagggcaucauggcaauugggaucguuuccauacuccugagcucgcuacugaagaacgacgugccucuugcuggaccccucaucgccggcgguaugcugauugccuguuaugucaucucagggucuagugcugauuuguccuuagagaaagcagccgaagugagcugggagcaggaagcggagcauucuggagcuagccacaauauucugguagaagugcaagacgauggcaccaugaagaucaaagacgaggagcgcgaugacacgcucacuauacugcuuaaggccacccuguuggcagucuccggcguuuacccaaugucaauuccugccacacuauucgugugguauuucuggcagaaaaagaagcagcggaguggggugcugugggauacccccagcccaccggaagucgagagagcugugcucgacgauggaaucuacaggauccugcagcguggucuuuuaggccgcucucaaguugggguaggaguguuucaggacggcgucuuccauacaauguggcacgugacucggggugcaguucugauguaucaggggaaaagacucgaaccuuccugggccucagugaagaaagacuugauuaguuacggaggcggcuggagguuucaggggagcuggaacaccggagaggagguccaagugauagcgguagaacccgguaagaaucccaaaaauguccagacgacacccggcacuuucaagaccccugagggggaagugggagcuaucgcccuggauuuuaagccaggcacauccgguucucccauuguuaaucgagaggggaaaaucgugggacucuacggcaacggcgucgugaccacuucggggaccuauguuagcgcaauugcccaggcuaaggccucacaagaaggaccucugccggagaucgaggacgaaguguucaaaaagcggaaucuuacaauaauggaucugcacccagguuccggcaaaacgcgcagauacuugcccgcaaucgucagggaggcuauuaagcggaagcuacgaacucugauccucgccccuaccagagugguagcgagugaaauggccgaggcauuaaaagggaugccaauucgcuaucagacaaccgcugugaagucugaacauacuggaagggagaucguugaccugaugugccacgccacauuuaccaugcgucuucugagccccguccgggugccuaacuacaauaugauaauuauggaugaggcucauuucacggacccggcauccaucgccgccagaggcuauaucucaacuaggguggguaugggggaagcugcggcaauuuuuaugacagccacaccaccaggaucugucgaggcuuucccucagagcaacgccguaauccaggaugaagaacgcgacauacccgaacgaaguuggaacuccggcuacgauuggauuaccgacuuuccaggcaaaacugugugguucguuccuagcaucaagucugggaacgauauugcaaauugucucaggaaaaacggaaagcgggugauccaauugucaaggaagacauucgacaccgaguaucagaaaacaaagaacaaugacugggauuacgucgugacuacggacauauccgagaugggugccaacuuucgcgcugaucguguuauugaccccagacggugccugaaaccagugauccucaaggauggcccggaaagggucauccuggcggggccuaugcccgugaccguagccagugcagcucagcgccgaggaagaauuggccggaaucagaacaaagagggugaccaauacguguauauggggcagccacuuaauaacgaugaagaccacgcccauuggacagaggcaaagaugcuacuggauaauaucaacacucccgagggcauuauaccugccuuguucgaaccagagagggaaaagagcgcugccaucgacggagaguaccgcuuaagaggcgaagcgaggaaaaccuuuguugagcugaugcggcguggggaucuccccgucuggcugucguauaagguggcaucugagggauuccaguacuccgaccgccgauggugcuuugauggugaaagaaauaaccaggugcuugaggaaaauauggacgucgagauuuggacaaaagaaggcgagaggaagaaacugcggccucgcuggcucgacgccagaaccuauagcgauccguuggcucugagggaguucaaggaauuugccgcugggcggcgaucaguuaguggagaccuaauccuggagaucggcaaacucccacaacaccuuacucugagagcacagaacgccuuagauaauuuggugaugcugcacaacucugaacagggugggaaggcuuaccgccaugccauggaggaacuccccgacacgauugagacccugaugcuucuggcacucauagcgguauugacaggcggagugacucuguucuuuuuauccggcaaggggcuaggaaaaaccagcaucggucugcucugugucacagccucaagugcacuucuguggauggccagcguggagccucacuggauugcagcuuccaucauuuuggaguucuuucugaugguucuccugauccccgagccagauaggcagcggaccccucaagacaaucagcuugccuauguggucauaggccuccuguucaugaucuugacuguagcagccaacgaaauggggcuguuagagacaacgaagaaagaucuaggaauuggcuacguggcugcggagaaccaucagcacgccaccaugcuggacguugaucuccgucccgcaucugcuuggacucuuuacgccguggccacaaccgucaucaccccaaugaugagacacacaauugaaaauacuacggcaaacaucagccugaccgcuauagccaaucaagcggcuauuuugaugggucuggacaagggguggccuaucuccaaaauggauauuggcgugccgcuccuggcccuuggaugcuauucacaggucaaccccuuaacacugacugcagccgugcucauguugguugcucauuacgcaaucauaggcccagggcugcaggccaaggcgaccagggaggcucagaagcgcacagccgcaggaaucaugaaaaauccuaccguggacggcauuguagccaucgaucuagaccccguggucuaugacgcuaaguuugaaaaacaacugggucagauuaugcuccuuauccuguguacuucucagauauugcugaugcggacgacaugggcccucugcgagaguauuacccuggcaacugggccauuaaccacacuuugggaaggaucgccuggcaaguucuggaacacuaccaucgcuguuagcauggccaauaucuuccgagguuccuaccuggcgggcgccgggcucgcauuuucucuaaugaaaucacugggaggcgggagaaggggaacaggcgcucagggugagacguugggggagaaguggaagcgccaacugaaccagcucagcaaauccgaguucaauaccuauaagcggaguggaauuauggagguggauagaucugaagccaaagagggccuuaagcguggugaaacuacaaaacacgcagucagcaggggcaccgcuaagcugcggugguuuguggagcgcaacuugguaaagcccgaggggaaagugaucgaccugggauguggccgagggggauggucauacuauugcgccggccucaagaaaguuacugaagugaaggguuacacaaaagggggaccgggccaugaggaaccaauaccuauggccaccuacggcuggaauuuagucaagcugcacuccgggaaagauguguucuuuaugcccccagagaagugugacacgcuucugugcgauauuggagaaaguagccccucuccuaccaucgaggaggguagaacacuaaggguccucaagaugguggaaccguggcugcggggcaaccaguucuguauuaaaaucuugaaucccuauaugccauccguuguagagacucuggaacagaugcaacgcaagcaugggggaaugcucgugagaaacccucuuucaaggaauagcacccacgagauguacugggucucgugcggcacagguaacauagugucugcgguuaauaugacaagucgaaugcuguuaaaccgguuuaccauggcucaccguaaacccacauaugagagagacguggaucugggggcaggaacccgccaugucgccguggaaccugagguagcuaacuuggacaucauuggccagaggaucgaaaauauuaagaacgagcacaaauccacuuggcauuacgaugaagacaauccauauaagacgugggccuaccacggcagcuaugaggugaagcccucaggguccgcaucuagcaugguuaacggagucgugcggcuccugacaaaaccuugggaugugaucccaauggucacccagauugccaugacugacaccacacccuucggucaacagagaguuuuuaaggagaaaguggacacgcgcaccccgagggcuaagcgaggcacuacacagaucauggaaguaaccgcgaaauggcuauggggguuccuuagucggaauaagaagccuagaauauguacuagggaggaauuuacacgcaaagugcguuccaacgccgcaauuggagcugucuucguggaugagaaucaguggaacagcgccaaggaagcaguugaggacgagcgguuuugggaucuggugcacagagaaagggagcuccauaaacaaggcaagugcgcaaccugcgucuacaauaugauggguaaacgcgaaaagaagcugggggaguucggaaaagcuaagggcucucgagccaucugguacaugugguugggcgcgcgguuccuggaauuugaggcacucggguucaugaacgaggaccacugguuuucaagagaaaauagucuuuccggaguggagggugaaggccugcauaaauuaggguauauccugagggauauuagcaagauaccaggaggcaacauguacgccgacgauacagcugguugggacacucgcaucaccgaggaugacuugcagaaugaggccaaaauuacggauaucauggaacccgagcacgcacuccuggcuaccucuauuuucaagcuaacauaucagaacaaaguaguuagagugcagcggccugccaagaaugggacugucauggacgugaucucgaggcgugaucaacgaggaucaggccaggugggcaccuacgggcuuaacacauuuacuaacauggaaguccagcugauacgccagauggagagcgaaggaaucuuccucccauccgagcuggagacccccaauuuggcugaaagaguuuuagacuggcuggagaagcauggugccgaacggcucaaaaggauggcaauuaguggcgacgauugugugguaaagccgaucgacgaucgcuuugcgacggcccuuacagcucugaacgacauggggaaagugagaaaggauauuccucaaugggagcccucuaaaggauggaaugacuggcagcaggucccauucugcagccaccacuuucaucagcuaaucaugaaggauggccgggaaauagugguuccuuguaggaaccaagacgagcuggugggucgagcccgugucucccagggggcaggauggucacucagagagaccgcuugcuugggcaagaguuaugcccagauguggcaacugauguacuuccaccgccgggaucuuaggcuggcagccaaugcgauuuguucugcugugcccguagacuggguuccaacuagcagaacaaccugguccauccaugcccaccaccaguggaugacuaccgaagauaugcucucaguguggaaccgcgucuggaucgaggaaaaucccuggauggaggacaaaacacaugugagcucuugggaagagguuccuuauuuaggcaagcgggaggaccaguggugcgggucccugauuggauugacggcaagggccaccugggcuacuaacauacagguggccaucaaucaaguccgaagacugauugguaacgaaaauuaccucgauuacaugacaaguaugaaacgguuuaagaacgagagcgacccagaaggcgcacuuugguga

SEQ ID NO: 13250 - RNA, 9879 nt, Artificial Sequence
  derived and/or modified CDS sequence (opt3) from DENV-1__KJ189303__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugugaucggcacaucgauuacccagaagggcaucauauucaucuuacugaugcuugucacgccaucaauggcuaugcgcugcguggggauuggaaacagagauuuuguagaggguuugagcggcgccacuuggguugacgugguccuggagcacgggaguugugugacaaccauggcgaagaauaaacccacucuagauaucgaacuccugaagacagaggugaccaacccugcaguccuuaggaaacugugcauugaagccaagaucuccaauacgaccacagacucucgguguccaacucaaggagaggcuaccuugguugaagagcaggaugccaacuucgugugccgccgaacauuuguagacagaggcugggguaauggguguggacucuucggcaaaggcagccuguuaacuugcgcaaaguuuaagugcgugaccaaacuggaggggaagauaguccaguacgaaaaccucaaauauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaaggacuggacuagauuucaacgaaauggugcugcucacaaugaaggagaaaagcuggcugguacauaagcagugguuucuugaccugccguugcccuggacgucuggcgccuccaccucacaagagacuuggaaucggcaggaucuccugguuacauucaaaaccgcacacgcuaagaagcaggaaguggucguguuagguagccaagagggggccaugcacacagcucugacuggcgccaccgaaauccagacgaguggaaccacaacuauuuuugcaggccaucuaaaaugccgucucaagauggacaaacugacccuuaaggggaugucuuaugucauguguacaggauccuucaaauuggagaaggaaguggccgagacucagcacgguaccguucuggugcagguaaaguacgagggcacggaugcuccuugcaaaauaccauucagcacacaagacgaaaagggggucacccagaacggacgccucaucacugcgaaucccauugugacagauaaagagaagccuguuaacaucgaaaccgagccacccuuuggcgagucguauauaguggucggugcaggggaaaaagcccugaagcuuucuugguucaagaaaggcuccucaauuggaaagauguuugaggcuacugccagaggcgcaaggcggauggccauccugggggacaccgcuugggauuucggaaguaucgguggcguguuuacaagcguagggaaauuggugcaucagguuuucggaacggccuacggcguccucuuuuccggugugucuuggaccaugaagauugggaucggcauucuguuaacuuggcugggacuaaauagccgaucaacaagucucuccaugaccuguauagcagugggcauggucacacuguaccuugggguuauggugcaggcggacagcggaugcgugaucaacuggaaaggccgcgaauugaagugugguucugggauuuucguaacuaacgagguccacaccuggacggaacaauauaaguuucaggcugauucaccgaaaagacugagugccgcaaucggaaaggccugggaggagggcgugugcgguaucaggagcgcuacacggcucgaaaauauuauguggaaacagauauccaacgagcugaaucauaucuuacuggaaaacgacaugaaguucaccguuguggucggcgacgccaaugggauucuugcacagggaaaaaagaugauccgcccucaacccauggagcacaaauacucuuggaagucguggggcaaggcuaaaauuaucggggccgauacucagaacaccacauuuauaaucgacggaccagauacuccugaaugucccgacggccagagagcguggaauauuugggagguggaggauuaugguuucgggaucuuuaccacaaacauuugguugaagcucagggacagcuacacgcagaugugcgaucaccgucugauguccgccgcuaucaaagacucaaaggcaguucaugccgauaugggauauuggauagaaagugagaaaaaugaaaccuggaagcuagcucgggccucuuucauugaggugaagacuuguacauggccaaaaagccacacccugugguccaacggcguacucgaaucagagaugaucauucccaagaucuacgguggcccuauaagccaacauaauuaucgaccaggguacuucacucagacagcaggaccguggcaccugggcaaacuugaguuggacuuugaucugugcgaagggaccacggucgugguggacgagcacugcggaaacagaggccccucuuuaaggacuaccacagucaccgguaagaucauucaugaaugguguugccgcuccuguacucucccuccacugcgguucagaggggaggauggaugcugguacggcauggagaucaggcccguuaaagaaaaggaggaaaaucuugugcgcaguaugguaagcgcggguucuggcgagguggacuccuuuucacuggggauuuugugugucaguaucaugauagaagaggugaugcgaagccgguggucgcguaagaugcucaugacaggaacccuggccguuuuccuacugcucauuaugggccagcugacauggaacgaccuuacuagauugugcaucauggugggggcuaaugccuccgauaggaugggaaugggcaccacguaucuggcauuaauggcuacauuuaaaaugcgcccuauguucgccgucggucuccuguuucggagacuuaccucuagggaggugcugcuacucacuaucgggcugagcuugguugcaucaguggaacugccaaacaguuuagaggaacucggagacggccuggccaugggcauuaugaugcuuaagcuguugaccgaguuccaaccccaccagcucuggacaacucugcuaucccugaccuuugucaaaacgacacuuucucucgauuacgcuuggaagaccacugcgaugguacugagcaucguguccuuguucccgcuguguuuaucaacaaccagccagaaaacuacauggcucccuguucugcuugggaguuuuggaugcaagccacugaccauguucuugauuacggaaaacaagauauggggucgaaaaucuuggccccucaaugagggcaucauggccauugggaucguguccauucugcuaagcucgcugcuuaagaacgacgucccucucgcaggaccccugaucgcuggcgguauguugauagccuguuaugugaucucagggucuagugccgauuuaucccuggagaaagcugcagaaguaagcugggagcaggaagccgagcauucuggagcgagccacaauauucucguggaaguccaagacgauggcacuaugaagaucaaagacgaggagcgcgaugacacccugacaauucuucugaaggcuaccuugcuagccguuuccggcguguacccaaugucaaucccugcaacacuguuugugugguauuucuggcagaaaaagaagcagcggagugggguccucugggauacucccagcccaccggaaguggagagagccguucuggacgauggaauauacaggauucuucagcgugguuuacugggccgcucucaaguaggggugggagucuuccaggacggcguguuucauaccauguggcacguuacgcggggugcugugcucauguaucaggggaaaagauuggaaccuuccugggcaucagucaagaaagaccugaucaguuacggaggcggcuggagguuccaggggagcuggaacacaggagaggaggugcaaguaaucgccgucgaacccgguaagaauccaaaaaacgugcagacuacccccggcacauuuaagaccccugagggggaaguuggagcgauugcucucgauuucaagccaggcacuuccgguucucccauagugaaucgagaggggaaaaucgucggacuguacggcaacggcgugguuaccacaucggggacguaugugagcgccauugcacaggccaaggcuucacaagaaggaccucuuccggagaucgaggacgaagucuuuaaaaagcggaaucugacuauuauggauuugcacccagguuccggcaaaacccgcagauaccuacccgccaucgugagggaggcaauaaagcggaagcugcgaacacucaucuuagcuccuaccagaguaguggccagugaaauggcggaggcccugaaagggaugccaauucgcuaucagacuacagcaguuaagucugaacauaccggaagggagaucgucgaccuuaugugccacgcuacguucacuaugcgucugcucagccccgugcgggugccuaacuacaauaugauuaucauggaugaggcccauuuuacagacccggcuuccauagcagccagaggcuauauuucaaccagggucgguaugggggaagccgcugcgaucuucaugaccgcaacucccccaggaucuguagaggccuuuccucagagcaacgcugugauccaggaugaagagcgcgacauucccgaacgaaguuggaauuccggcuacgauuggaucacagacuucccaggcaaaaccguuugguuugugccuagcauaaagucugggaacgauauugccaauuguuugagaaaaaacggaaagcgggucauccaacugucaaggaagacauucgacacugaguaucagaaaacgaagaacaaugacugggauuacgugguuaccacagacauuuccgagaugggugcaaacuuccgcgccgaucgugugaucgaccccagacggugccucaaaccagucauacugaaggauggcccggaaagggugauucuugcugggccuaugcccguaacuguggcgagugccgcacagcgccgaggaagaaucggccggaaucagaacaaagagggugaccaauacguuuauauggggcagccacuaaauaacgaugaagaccacgcucauuggaccgaggccaagaugcuguuggauaauaucaacacacccgagggcauuaucccugcauuauuugaaccagagagggaaaagagcgccgcugucgacggagaguaccgccugagaggcgaagccaggaaaaccuucguggagcucaugcggcguggggaucugcccguguggcuuucguauaaggucgcgucugagggauuucaguacuccgaccgccgauggugcuucgauggugaaagaaauaaccagguucuggaggaaaauauggacguggagauuuggacuaaagaaggcgagaggaagaaacuccggccucgcugguuggacgcaagaacguauagcgauccgcuggcccuaagggaguuuaaggaauucgcugccgggcggcgaucaguaaguggagaccugauacucgagaucggcaaacuuccacaacaccugaccuuaagagcucagaacgcauuggauaaucuggugaugcuccacaacucugaacagggugggaaggccuaccgccaugcuauggaggaacugcccgacacaauugagacucuuaugcugcucgccuugaucgcaguccugaccggcggagugacauuauuuuuccuauccggcaaggggcugggaaaaaccagcaucggucuccuuuguguuacugcgucaagugcccuguuguggauggcuagcguggagccucacuggauugccgcauccauaauccuggaauuuuuccucaugguccugcuuauucccgagccagauaggcagcggacaccucaagacaaucagcucgcuuauguagugaucggccuguuguuuaugauucugacgguugccgcaaacgaaaugggguuacuagagaccacuaagaaagaucugggaaucggcuacguggccgcugagaaccaucagcacgcgacaaugcucgacgucgaucuucgucccgccucugcauggacccuguacgcuguggccaccacagucauaacuccaaugaugagacacacgaucgaaaauaccacagccaacauuagcuugacugcaaucgcuaaucaagccgcgauucugaugggucucgacaagggguggccuaucuccaaaauggauauaggcgugccgcugcuugcuuuaggaugcuauucacagguuaacccccugacccucacagccgcaguguugaugcugguagcccauuacgcuauuaucggcccagggcuacaggcaaaggccaccagggaggcgcagaagcgcacugcugccggaauuaugaaaaauccuacgguggacggcaucgucgcaauagaucuggaccccguuguguaugacgccaaguucgaaaaacaacucggucagaucaugcuucugauuuuguguacaucucagauccugcucaugcggaccacuugggcucugugcgagaguauuaccuuagccacagggccacuuacuacccugugggaaggaucgccuggcaaguuuuggaacacaacgaucgcagucagcauggcuaauauauuccgagguuccuaccucgccggcgcggggcuagccuucucucugaugaaaucauugggaggcgggagaaggggaaccggcgcacagggugagacucugggggagaaguggaagcgccaacucaaccagcuuagcaaauccgaauuuaauacauauaagcggaguggaauuauggagguggauagaucugaagcuaaagagggccugaagcguggugaaaccacuaaacacgccguaagcaggggcacagcaaaguugcggugguucguggagcgcaaccugguuaagcccgaggggaaagugaucgaccucggauguggccgagggggauggucauacuauugcgcuggcuuaaagaaagucaccgaagugaaggguuacacgaaagggggaccgggccaugaggaaccaaucccuauggccaccuacggcuggaaucuggucaagcuucacuccgggaaagauguguuuuucaugcccccagagaagugugacacacugcuaugcgauauuggagaaaguagccccaacccuacuaucgaggaggguagaacccucaggguucugaagaugguagaaccgugguugcggggcaaucaguuuuguauaaaaauucugaaccccuauaugccaucuguggucgagacacucgaacagaugcaacgcaagcaugggggaaugcuugugagaaauccucuguccaggaacucaacucacgagauguacuggguuagcugcggcaccgguaauaucgugucggccgucaacaugacaucucgaauguuacugaaccgguucaccauggcgcaccguaaacccacuuaugagagagacguggauuugggggcuggaacgcgccauguagcaguggaaccugagguugccaaucucgacauuaucggccagaggauagaaaacaucaagaaugagcacaaaaguacauggcauuacgaugaagacaacccauauaagaccugggcuuaccacggcuccuaugaggucaagcccagcgggucagccuccucuauggugaauggagugguccggcugcuaacuaaaccuugggauguuauuccaauggugacccagaucgcaaugacagacacgacccccuuuggucaacagagaguauucaaggagaaaguggacacucgcacaccgagggccaagcgaggcaccacucagauuauggaagucacagcuaaauggcuuuggggguuucugagccggaacaagaagccuagaaucuguaccagggaggaauucacacgcaaagugcguaguaaugcggccauuggagcaguuuuuguggaugagaaccaguggaauuccgcuaaggaagccgucgaggacgagcgguucugggaucucgugcacagagaaagggagcugcauaaacaaggcaagugcgcaacuugcguauacaacaugauggguaaacgcgaaaagaaguugggggaguuuggaaaagccaagggcagccgagcuaucugguacauguggcugggcgcccgguuccucgaauucgaggcgcuuggguuuaugaaugaggaccacugguucucuagagaaaacucacugaguggaguugagggugaaggcuuacauaaacugggguauauauugagggauauuuccaagaucccaggaggcaauauguacgcagacgauaccgccgguugggacacgcgcaucaccgaggaugaccuccagaacgaggcuaaaauuacagauauaauggaacccgagcacgcccugcuagcaacuagcaucuuuaagcuuaccuaucagaauaaaguggucagagugcagcggccugcuaagaacgggacagugauggacgucauuucuaggcgugaucaacgaggaucgggccagguuggcacuuacgggcugaacaccuucacgaauauggaagugcagcucauccgccagauggagucagaaggaauuuuucugccaagcgaguuggagacacccaacuuagccgaaagaguacuggacuggcucgagaagcauggugcugaacggcuuaaaaggauggccaucuccggcgacgauuguguggucaagccgauagacgaucgcuucgcaaccgcgcugacugcccuaaaugacauggggaaagugagaaaggauaucccucaaugggagcccaguaaaggauggaacgacuggcagcagguuccauuuugcucucaccacuuccaucagcugauuaugaaggauggccgggaaaucguggucccuuguaggaaucaagacgagcucgugggucgagcucguguaagccagggggccggaugguccuugagagagacagcaugccugggcaagucauaugcucagauguggcaacuuauguacuuucaccgccgggaucugaggcucgccgcaaacgccauuuguagugcgguucccguggaaugggucccaaccucuagaacuaccuggagcauccaugcucaccaccaguggaugacaacggaggacauguuauccguguggaaucgcguuuggauagaagagaaccccuggauggaagauaaaacccaugugucaagcugggaggaggucccuuaucugggcaagcgggaagaccaguggugcgggucuuugauuggacugacugccagggcaacaugggccaccaauauccagguggcuaucaaccaaguacgaagacucauugguaaugagaacuaccuugacuacaugacuuccaugaaacgguucaagaaugaaagugauccagagggcgcccugugguga

SEQ ID NO: 13251 - RNA, 9879 nt, Artificial Sequence
  derived and/or modified CDS sequence (opt3) from DENV-1__KR028435__SS-prME
agcgugaccaugcugcucaugcuuaugcccacagcacuggcuuuccacuugacuacgcgaggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauuacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagggauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauaggggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauauguacugguagcuucaaacuggagaaggaagucgcugagacccagcacggaacggugcuuguucagaucaaguacgagggcacagacgcgccuugcaaaauuccauucucgacccaagaugaaaagggggugacucagaacggacgcuugaucacagcaaaucccauaguaaccgacaaagagaagccugucaacauugaagccgagccacccuuuggcgagucuuauaucgugaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguuuuuacauccguggggaaacuuguccaucagauauucggaacggcguacggcgugcuguuuucugguguaagcuggaccaugaagaucgggauuggcguguugcucacuuggcugggauuaaauucacgaaguacaucccugagcaugaccuguaucgcuguuggccuagucacacucuaccugggggugauggugcaggccgauucuggaugcgucaucaacuggaaaggccgcgaacuuaagugugguucagggauuuucguuacuaaugaggugcacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccguagucgugggcgauguugcugggauccuggcccagggcaagaagaugauacgcccucaacccauggagcacaaauacucguggaaaagcuggggcaaggcgaaaaucauuggggccgacgugcagaauacuaccuuuaucauugauggaccaaacacaccugaaugucccgacgaucagagagcuuggaauaucugggaggucgaggacuauggcuucgguauauuuacuaccaacauuuggcuuaaguugagggauuccuacacacaggugugcgaccaccgucucaugucagcagccaucaaagauaguaaggcuguucaugccgacaugggguauuggauugaaucugagaaaaaugaaacguggaagcuggcacgggcgagcuucaucgaggugaagaccuguauauggccaaaaucccacacucuauggucaaacggaguacuggaaagcgagaugaucauucccaagaucuacggcgguccuauuucucaacauaauuaucgaccaggcuacuucacacagaccgccgggccguggcaccucggaaaacuggagcuugauuuugacuugugcgaaggcacuacagucgugguggaugagcacugcgggaacagaggacccucccugaggaccacgacugucaccggcaagaucauacaugaaugguguugccgcaguuguacauuaccuccacuccgguucagaggugaggacgggugcugguacggaauggagauuaggcccguuaaagaaaaggaggaaaaucuggugaaguccaugguaucugcuggcuccggugagguggacucauuuagucuuggccuguuguguaucagcaucaugauugaagaggucaugcgcucgcgauggucccggaaaaugcucaugaccgggacucuggccguguucuuucuacugaucaugggacagcucacauggaacgaucugauucgucuuugcauaaugguuggcgcaaaugcuucugacagaauggggaugggaaccacauauuuggcccugauggcaacuuucaagaugaggccuauguuugccgugggcuuacucuuccgccggcugaccagcagagagguccuucugcuaacgaucggucucucacugguggcuaguguugaauugccaaacucccuggaggaauuaggggauggacucgcgaugggcauuaugauccugaaacuucugacagacuuucaaucucaccaguugugggccacccuccugagccuaacuuucauuaagaccacauuuucccugcauuacgcauggaaaacuauggcuauggugcuuucaaucgucagccucuucccccuguguuugaguaccacgucucagaagacaaccuggcugccgguauuacucggcucccuggggugcaagccucuuacuauguuucugauagccgagaauaaaaucuggggaagaaagagcuggccauugaacgaagguauuauggccgugggcaucguuucgauucuccugucaucucuacugaaaaacgaugugccccuugcugggccucucaucgcaggaggcaugcugauagccuguuaugucauuagugguuccagcgcggacuugucuuuagagaaggcugccgaggugagcugggaagaggaagcagagcacuccggggccucacauaauauccugguagaagugcaggaugacggaacaaugaaaaucaaggaugaggagcgagacgauacccucacuauucugcuuaaagcuacacuguuggcaauaaguggcgucuacccccuaagcaucccagccacccuguucguuugguauuucuggcaaaagaagaaacagcgcucuggcgugcucugggacacgccuucacccccagaaguggagcgggcgguccuggaugacgggauuuacagaaucaugcagaggggacuuuuaggucguagccaggugggcguugggguauuucaagaaaacguguuccacacuauguggcacgucacccgcggagcugugcugauguaucagggcaagcggcucgagccgaguugggccagcguuaaaaaggacuugauuuccuacggugggggauggagacugcagggcucuuggaauacaggcgaggaagugcaggucaucgcaguggagccugggaaaaaccccaagaauguacaaaccgccccaggaacauuuaagacucccgaaggugaggucggcgcuauagcccucgauuucaaaccugggaccucgggaagcccaaucgugaacagggaaggcaagauuguuggucuguacgggaauggaguggucacgacaucaggcacuuauguguccgcaaucgcucaggccaaagcgagucaggagggcccccuuccugagauugaagacgagguuuuucgaaagcggaaccugaccaucauggauuugcauccggggucuggaaaaacacgcagauaccuaccagccauagugagggaagcaauuaagcggaagcugcgaacccucaucuuagcucccacuagagucguggccagcgagauggcugaagcacugaaagguaugccuauccgcuaucaaaccacagccguaaaguccgagcacacgggcaaagagauuguggaccuuaugugccaugccacuuucaccaugaggcugcucucaccaguucguguccccaauuacaacaugaucauaauggaugaagcucacuuuacagacccuucuagcauugcggcacggggguauaucaguaccagagugggaaugggcgaggccgcugccauuuucaugacugcaacaccgcccgguuccguggaagccuuuccacagagcaaugcugucauccaggaugaggaagggggaauaucugagaggucauggaacuccggcuacgaguggauuaccgacuucccuggcaagacgguaugguuugugcccaguaucaaaagcgggaaugauaucgcgaacuguuugcgcaagaauggaaagcgaguuauucagcugucgagaaaaacuuucgacacagaauaucaaaagaccaaaaacaacgauugggacuacguggucaccacugacaucucugagaugggugccaauuuccgggcagauagggugauugacccacgccguugccucaagccuguuauacugaaagauggccccgaaagagugauccuugcugggccaaugccggucacaguggccuccgcagcccagcggaggggacgcauuggccgaaaccauaauaaggagggugaccaguacaucuauauggggcagccucuaaacaaugaugaggaccacgcucacuggaccgaagccaagaugcuguuggauaacaucaauacacccgagggcauuauaccagcguuauuugaacccgagagagaaaagagcgcagccaucgacggagaguaccggcugaggggcgaggcucgcaagacuuucguagagcucaugagaagaggggaucugccuguguggcuuucauauaaaguugccagugagggauuucaauacucugaccggcguuggugcuucgauggugaacgcaacaaucagguccuggaggaaaacauggacguggagauuuggacgaaggagggcgaaagaaagaagcucagaccaaggugguuggaugcucggaccuauuccgacccccuggcacuacgcgaguuuaaagaguucgccgcugggagaaggagcgugucaggagaccugauccucgagauuggcaaacuuccucagcaucugacacagcgggcccaaaaugcauuagauaacuuggucaugcugcacaauagugaacagggugggcgagcguacagacaugccauggaggagcucccggacacuaucgaaacccugaugcuucuggcucucauagccguuuugacaggcggagugacccuguuuuucuuaagcggccgcgggcuaggaaagacuuccaucggucugcucuguguaauggcaucuagcgugcuucuguggauggcuuccgucgagccacacuggauugccgcaucaaucauuuuggaauuuuuccugauggugcuccugauccccgagccugauaggcagcggacgccccaggacaaccaacuugccuauguugugauaggccuccuguuuaugauuuugaccgucgcugcgaaugagauggggcuguuagaaacaacuaaaaaggaucuaggaaucggccacguagccguggagaaccaucaccaugcaaccaugcuggacguugaucuccacccagcuucugccuggacacuuuacgccguggcaaccacuauuaucacaccuaugaugcgucauacgauagaaaacaccacugcuaauaucagucugacagccauugcgaaccaggcugccaucuugaugggucuggacaaaggguggcccauuucgaagauggauaucggcgucccacuccuggcacuuggaugcuacagccaggugaauccuuuaacccugaccgccgcuguccucauguugguggcacacuaugccauaauuggcccggggcugcaagcgaaagcuacaagagaggcccagaagaggacugcagccggaaucaugaagaaccccacgguugacggcaucguggcuauugaucuagacccaguaguguacgaugccaaauucgaaaagcagcugggucagaucaugcuccuuauacuguguaccucccaaauuuugcugaugcgcacaacuugggcacucugcgagucuaucacccuggcuacagggccuuuaaccacucuuugggagggaucacccggcaaauuuuggaauacgacaauugccgucagcauggcgaacaucuuccgggguuccuaucuggccggcgcagggcucgcuuucagucuaaugaagucucugggaggcgggcgaagaggaaccggcgcccagggugaaacuuugggggagaaauggaagaggcagcugaaucagcucagcaagucagaauuuaacaccuacaaacgcuccggaauaauggagguugaccggagugaagcaaaggagggccuuaaaagaggugagacaacuaagcacgcugugagccguggcaccgccaaacugaggugguucgucgaacggaauuuggugaagccagaggggaagguaaucgaccugggauguggccgcgggggauggucuuauuacugcgccggccucaaaaaggugacagaaguuaaagguuauacgaaagggggaccuggccaugaggaacccauuccgauggcgaccuacggcuggaacuuagugaaacuguacuccgggaaggaugucuuuuucaucccaccugagaaaugugacacucuucugugcgauauuggagagucaagccccaauccaacaaucgaagagggucgaacccuaagagugcucaagauggucgaacccuggcugaggggcaaccaauuuuguauuaagaucuugaauccuuauaugccgucggugguugagacucuggagcagaugcagcggaaacacgggggaaugcucguacgcaacccccuuucuagaaauaguacacaugaaauguacuggguguccugcggcaccgguaacauagucagcgcugugaauaugacgucaaggaugcuguuaaaccgauucaccauggcacaccggaagccaacauaugagcgugacguugaucugggggccggaacuagacacguggcugucgaaccugagguggccaacuuggacauuaucggccagcgcaucgaaaauauuaaacaugagcacaaguccaccuggcauuacgaugaggacaaccccuauaaaacaugggcauaccacggcucuuaugaaguaaagccuagcgggagugccuccagcauggugaauggaguugucaagcuccugacuaaaccaugggaugugauacccauggugacccaaaucgcuaugacagacaccacuccuuuuggucagcagagggucuucaaggagaaaguugauacgcggacaccaaaggcgaaaagaggcaccgcccaaauuauggaagugacugcacgcuggcuauggggguuucuuucuaggaacaagaagccccgaaucuguacccgggaggaguucacaagaaaaguaaggucaaaugcugccauuggagcaguguuuaucgacgagaaccaguggaauagugccaaggaggcugucgaagacgagcgcuucugggaucuggugcaucgugaacgggagcuccacaaacagggcaagugcgccacgugcguuuacaacaugauggguaaaagagaaaagaagcugggggaguuuggaaaagcgaagggcuccagggcaauaugguacaugugguugggcgcccgcuuccuggaguucgaagcucucggguuuaugaaugaggaccacugguucagccgagaaaacucucuuucgggaguggagggugagggccugcauaaauuaggguauauccugcgggauauuucaaagaucccgggaggcaauauguacgccgacgauaccgcagguugggacacuagaauuacagaagaugacuugcagaacgaggcuaaaaucaccgauauaauggaaccugagcacgcccuccuggcuaaggccauuuuuaaacuaacuuaucaaaauaaggucgugaggguacagcgcccagcaaagaacgggacaguuauggacgugaucagcagacgggaucagaggggauccggccaggucggcaccuacgggcuuaauacauucacuaacauggaagcgcaacugauccgucagauggagagugagggaauauuuucucccagcgaacucgagaccccuaaccuggccgaacgaguguuggacugguuagagaaauaugguguggaacgccugaagagaauggcuauauccggcgaugacugugucguuaaaccaaucgacgaucgguucgccacggcacucaccgcucuuaaugacauggggaaggugaggaaagauauuccccagugggagccgucaaagggauggaacgacuggcagcaaguaccuuuuugcagucaucacuuccaccagcugaucaugaaggauggccgcgagauugugguccccuguagaaaucaggacgagcuagugggucgggccaggguuucucagggggcaggauggagccugcgagagacagccugccucggcaaauccuacgcgcaaauguggcaguugauguauuuucaucguagagaucugcgccuugcugccaacgcaaucuguucagccgugccagucgacugggugccuacuagccggaccacauggucuauacacgcucaucaccaguggaugacuaccgaagauaugcuguccguauggaauaggguuuggaucgaggaaaaccccuggauggaggacaagacgcauauuaguagcugggaggaugugccauaccucggcaaaagagaagaccaauggugcgggucguuaaucggacugacagcccgcgcaaccugggcuacuaauauucaggucgccaucaaccaggugcggagguugauugguaaugagaacuaccuggacuauaugacauccaugaagcgauucaaaaaugaaucugaucccgagggcgcgcucugguga

SEQ ID NO: 13252 - RNA, 9879 nt, Artificial Sequence
  derived and/or modified CDS sequence (opt3) from DENV-1__JQ922548__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccauacaaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaggaauaagcccacacuagauaucgaacuccugaaaaccgaggugacgaacccugcagugcuucggaagcugugcauugaagccaaaaucuccaauaccacaacugacucucgcuguccaacccaaggagaggcuacauuggucgaagagcaggaugccaacuucguuugccgaagaacuuuuguggacaggggcugggguaauggguguggacucuucggcaagggcagccuguuaaccugcgcaaaauuuaagugcguaacaaagcuggaggggaaaauagugcaguacgaaaaccucaaguauuccgucauugugaccguucacacuggagaucagcaucaaguggguaaugagacgacagaacacggcaccaucgcuacuauuaccccccaggccccuaugucagagauccagcuuacagacuacggggcgcugaccuuggacuguaguccacggacuggacuagauuucaacgaaaugguccugcucacaaugaaagagaagagcuggcuggugcauaaacagugguuucuugaccugccguugcccuggacgucuggcgccuccaccucacaagagacuuggaaucgucaggaucuccugguaacauucaagaccgcacaggcuaaaaagcaagaaguuguggucuuagguagccaggagggggccaugcacacagcucugacuggcgccaccgaaauccagacgaguggaaccacaacuauguuugcaggccaccuaaagugccgccucaaaauggacaagcugacccuuaaaggggccucuuaugugauguguacaggaccuuucaaguuggagaaagaagucgcugagacucagcaugguaccgugcugguucaagugaaguacgagggcacggaugcgccaugcaagauucccuucuccacacaggacgaaaaagggguaacccagaacggaagacucauaacugcaaauccuaucgucacagauaaggagaaaccagugaacauugaaaccgagcccccguuuggcgagagcuauaucguuauaggugccggggaaaaggcucugaaacuuucgugguucaagaagggcucuuccauuggaaaaauguuugaggccacugcaaggggcgcccggcgaauggcuauccugggggacaccgccugggauuucggaucaaucgguggcgcauuuacaaguguggggaaguugguccaccagguguucggaacggcguacggcguacucuuuagcgguguguccuggaccaugaaaauugggaucggcauucuguuaacuuggcugggacuaaauucucgcagcacaucacucaguaugaccuguauagcuguuggcauggucacacuguaccuuggggugauggugcaagccgacuccggaugcgucaucaacuggaagggcagagaauugaaaugugguagcgggauuuucguuacuaacgaggugcauaccuggacggaacaguauaaguuucaggcagauucuccuaagaggcugucagccgcuaucggaaaagccugggaggagggcgugugcgguauccggagugcaacacgccucgaaaauauuauguggaagcagauaagcaacgagcugaaucacaucuuacuggaaaacgacaugaaauucaccguagucgugggcgacgcuaaugggauucuuacucaaggaaagaaaaugaucagaccccagccaauggagcauaaguacuccuggaaaucuuggggcaaggccaagauuaucggggcggaugcccagaacaccacauuuauaaucgacggaccugauacucccgaauguccagacgaucagagggcuuggaauauuugggagguugaggacuauggcuucgguaucuuuaccacaaacauuugguugaaacuccgugauucguacacgcaaaugugcgaccaccggcugaugagcgcagccaucaaggauuccaaagcugugcacgccgacaugggguauuggauagaaucagagaagaaugaaaccuggaaacuaacucgagcaaguuucauugaggucaagacauguaccuggcccagaucucauacucuguggagcaacggagugcucgaauccgagaugaucauuccuaagaucuacggcgguccaauaucacagcacaauuauaggccgggcuacuucacacagaccgcggggcccuggcaucugggaaaacuugaguuggauuuuaaccugugcgaaggcacgacuguugugguagacgagcacugcgggaauggaggcgccagcuuagguaccacaaccgucacugggaagaucauucacgaaugguguugccgcucuuguacacucccuccacugcgguuccuuggagaggauggcugcugguacgguauggagaucagacccgugaaagaaaaggaggaaaaccuguuuagguccauggugagugcuggcagcggggaggucgacucuuucuccuugggacuccuguguguuucaauuaugaucgaagaggugaugcgcagucgauggagccggaaaaugcuaaugaccggcacacuggccguauuuuuccuccugauaauggggcaacuuacuuggaaugacuugauucgucugugcaucauggugggagcaaacgcuucggauagaaucggcauggguaccacguauuuagcccucauggcaacauuuaagaugaggccuauguucgccgucgggcugcuuuuucgccggcugaccuccagagaggugcuacuccugacuauuggauugucucugguugcuagcguggaauuaccaaacucacucgaggaacugggcgacggccuugcgauggggaucaugaugcugaaguugcucaccgauuuccagagucaucagcuguggacaacucuacugucccuuaccuuuauuaaaacgacacucucucuggacuacgccuggaagaccauagcaauggucuugagcaucgugucccuguuccccuuaugucucucaacuacaagccagaaaaccacuuggcugccgguucuucugggaaguuuugguucuaagccuuugacaauguuccucauuaccgagaauaaaaucuggggcaggaaguccuggccacugaacgaagggauuauggcugugggaaucgucagcauacuacugucgucacuucccaagaaugauguaccucucgccggcccccugaucgccggugggauguugauugcuugcuaugugaucucuggaaguuccgcagacuuaagccuggagcgagccgcggagguuucuugggaagaggaagcugagcacagcggcgccucccauaacauucucguggaaguccaagaugacggcaauaugaaaaucaaggaugaggagcgcgacgauucacugacgauacuucugaaagcaacuuugcuagccgugagugggguauacccaaugagcauuccugcuacccuguucgugugguauuuuuggcagaagaaaaagcagcggucuggaguccucugggacacacccuccccaccggaaguugugagagcagugcuggaugacgguaucuacaggauccuucagcguggcuuacuggggcgcucacaagucggagugggcguuuuccaggacgguguauuucacaccauguggcaugugacacggggggccguccucauguaucagggaaaaagauuggagccuaguugggcgagcgugaagaaggaucugauuuccuacggcggcggguggagguuccagggaucuuggaacacuggugaagagguucaagugauagcugucgagcccggcaaaaauccaaagaacgugcagaccacgcccgggacauuuaaaacuccugaaggagagguaggcgccaucgcacucgacuucaagccagguaccucggggagccccauugucaaucgagaaggaaaaaucgugggccuguacggcaacgggguugugacaaccucaggaacuuaugucuccgccauugcucaggccaaggcaagucaagaggguccucuuccggaaaucgaggaugagguguuuaagaaacggaaucugaccauaauggacuugcacccaggcucugggaagacacgcagauaccuacccgcuaucguuagggaagccauuaaacggaagcugcgaacgcucaucuuagcgccuacuagaguggucgccagcgagauggcagaagcucugaaaggaaugccaauucgcuaucagaccacagccgugaaguccgagcacaccggcagggaaaucguagaucuuaugugucaugcuaacuucacuaugcgucugcucucacccgugcggguuccuaauuacaacaugauaauuauggacgaggcacacuuuacagauccggccucuaucgccgcuagagguuauaucagcaccagggucgggaugggagaggcggcagccauuuucaugacggcuacucccccaggcaguguggaagccuuuccucaguccaaugcagugauccaggacgaggaacgcgauauacccgagcgaagcuggaacucuggcuacgacuggauuacagauuucccagggaagaccgucugguucguaccuucaaucaaauccggaaacgacauugccaauugcuugagaaagaacgguaaacgggugauccaacugaguaggaagaccuuugacacugaauaucagaaaacaaagaauaacgauugggacuacguugugaccacagauauaagcgagaugggcgcuaauucgcgcacugaccgugucauugaucccagacggugucucaagccagugauccugaaagacgggccggagaggguuauccuugcgggaccuaugcccgugacggccgcaucugcugcccagcgccgaggcagaauuggucggaaccagaauaaggaaggggaucaauacaucuauaugggccagccacuaaacaaugacgaggaucaugcacacuggaccgaagccaaaaugcuguuggacaacauuaauacacccgagggaauaaucccugcuuuauucgagccagaaagggagaaguccgccgcgauugauggcgaauaccgccugagaggggaggcaaggaaaacuuuugucgaacucaugcggcguggagaccugcccguguggcuuagcuauaagguagccucagaggguuuccaguacagugaucgccgauggugcuuugacggcgagagaaacaaucaggugcuggaagagaacauggacguugaaaucuggaccaaggagggggaaaggaaaaagcuccggccucgcugguuggaugcuagaacauauucugacccgcuggcccuaagggaguucaaagaguuugcugcaggacggcgauccgucagcggcgaucugauccucgaaauugguaagcuuccacaacaucugaccuuaagagcccagaaugcuuuggacaaccuggugaugcuccacaacucagagcaggggggcaaagccuaccgccacgcaauggaagagcugcccgauacuauagaaacgcuuaugcugcucgcguugaucgccgugcugaccggaggcgucacauuauucuuucuaagugggaagggacuggguaaaacuagcauuggccuccuuugcguuauggcuuccucugugcuguuguggauggccagcguagagccucauuggaucgcagcuuccauuauccuggaguucuuucucaaggaacugcuuauacccgacgccgaugggcagaggaccccacaagacaaucagcucgcauauguggucaucggacuguuguucaugauucugacaguggccgcuaacgagaugggcuuacuagaaaccacuaagaaaaaucuggguaucgggcacguuguggcggagaaccaucaccacgccacaaugcucgauauugaccuucauccugcaucagcuuggacgcuguacgccgucgccaccacuaucauaacacccaugaugcggcacaccauugagaauaccacagcaaacaucucuuugacugcuauugccaaucaggcggcuauccugaugggccucgauaagggacguccaauaaguaaaauggacaucggcguaccucugcuugccuuaggguguuacucgcaagugaacccgcugacgcucaccgcagccguuuugaugcugguggcucauuaugcaauuaucggacccggccuacaggccaaggcgacaagagaagcucagaaaaggacugccgcaggucugaugaagaauccaaccgucgaugggauugccgcuaucgaccucgacccuguggucuacgaugccaaguuugagaaacagcuuggacaaauaaugcuguugauucugugcacaagccagauccuccugaugcgcaccacuugggcauuaugugaauccaucacgcuugcuacaggcccccugaccacucucugggaggguucuccaggcaaguucuggaacaccacaauugccgugucaauggcgaauaucuuccgggggagcuaucuagccggagcaggccuggcuuuuuccuugaugaaaagucuggggggaggccgaagagguacuggggcccagggagaaacccucggcgagaaguggaaaaggcagcuuaaccaacugucuaagagcgaguucaauacauacaagcgcucagguauaauggaaguugaccgguccgaggcaaaagaaggcuugaagagaggggagacgaccaaacacgcugugagucguggaacugccaagcugaggugguuuguagaacggaaccucgugaaaccugagggcaaggucauugauuuagggugcggacgcggcgguuggagcuauuacugugccgggcugaagaaaguuacagaggugaagggauauaccaaaggcggccccgggcaugaagagccgaucccaauggcgacuuacggauggaaucuugucaagcugcacucugguaaagacguguucuuuacaccucccgaaaagugcgauacccuacucugugacauuggcgaguccucaccaaaccccacgaucgaagaggggcgaacccugagaguauugaaaaugguggagccuuggcugaggggaaaucaguucugcauaaagauccucaacccguacaugcccagcguuguggaaacacuugagcagaugcagcggaagcacggcgguaugcugguccgcaacccauuaucgagaaauucuacucaugaaauguauugggugaguugugcuaccgggaacauugucuccgcagugaauaugacaagcaggaugcuguugaaccgauuuacuauggcccaccggaaaccuaccuacgagcgugauguugaccucggagcuggcacaagacauguagccguggagcccgaaaucgcaaaucuggauauuaucggccaacgcauugagaacaucaagaaugaacacaaaucaaccuggcacuaugacgaggauaacccuuacaagacuugggccuaucaugggacguacgaagucaaaccauccggaucugcuagcaguauggugaaugguguugugaggcuacuuacaaagcccugggacgucauaccuauggugacccagauugcgaugacugacaccacaccauucggccagcaacggguauuuaaggagaaaguggauacgagaaccccccgcccgaagagggggacugcccagaucauggagguuacagcacgauggcuguggggauuccucucccggaacaaaaagccuagaaucugcaccagggaagaguuuacucgcaaaguccguagcaaugcugccauuggcgcaguguucguggacgaaaaccaguggaauucugccaaggaggcugucgaagaugagcgguuuugggaccugguucacagagagagggaauugcauaagcaggguaaaugugccacaugcguguauaacaugauggggaagcgcgagaaaaagcugggagaauucggcaaagcgaagggcucacgagcaauaugguacauguggcucggggcccgguuccuugaguuugaagcucugggauucaugaaugaggaucacugguuuaguagagagaacuccuuaagcgguguagaaggcgaggggcugcauaaguugggauacauccucagggacauuucuaaaaucccaggcgguaacauguaugccgaugacaccgcagggugggauacacgcauuacugaagacgaucugcaaaaugaggcuaagaucaccgacauaauggagcccgaacacgcccuacuugcuacgucgaucuucaaacugaccuaccagaacaagguggucagagugcagcggccugccaaaucaggaacaguuauggaugugauuagcaggcgugaccagcgaggcuccggccaagucgggacuuauggacucaauaccuuuacaaacauggaggugcagcugauccgccagauggaaagugaggguauuuucucuccaagcgaauuggagaauuccaacuuagcagagagagcgcuggacuggcucgaaaagcacggcguagagcggcuuaaaaggauggccaucucaggggaugacugcguugugaagcccacugaugaccgcuuugcuaccgcccugacggcacuaaaugauaugggaaaggucagaaaagacauaccgcagugugaaccuaguaagggcuggaacgauuggcaacaggugcccuucugcucucaucacuuucaucagcugauuaugaaagacggucgggagaucguggucccauguaggaaucaggaugaacucguugggcgagcucgugugagccaaggagccggcugguccuugagagagacagcaugccugggcaagucauacgcccagauguggcagcuuauguauuuccaccgccgggaccugaggcucgcggcuaacgccaucuguagcgcaguaccugugaauuggguccccaccucuagaacuacaugguccauucacgcccaucaccaauggaugaccacugaggauauguuaaguguguggaaccgcguuuggauagaagagaauccauggauggaagacaaaacccaugugagcucgugggcugacguccccuaccuggggaagcgggaggaucaguggugcggauccuugaucggucuggccgcaagggcuacaugggccacgaacauucagguggcgcucaaucagguacgaagacuuaucggcaacgaaaacuaucuggacuacaugaccucuaugaagcgguuuaaaaaugagucagauccugagggggcucuaugguga

SEQ ID NO: 13253 - RNA, 9879 nt, Artificial Sequence
  derived and/or modified CDS sequence (opt3) from DENV-1__JQ922544__SS-prME
agcgugaccaugcugcucaugcuucugcccacugccuuggcuuuccacuuaacuacgcgaggaggggaaccucauaugaucgucuccaagcaggaaagggguaaaucucugcuauuuaagaccucagccgguguuaacaugugcacccucauugccauggaccugggcgaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccugcgagggggccuggaaacagauccagaagguggaaauuugggcucugaggcacccuggauucacuguuaucgcacuguuucucgcccaugcuauuggcaccucuaucacacagaagggcauaaucuucauuuuacugaugcuugugaccccaucgauggccaugcggugugucgggaucggaaaccgcgaguuuguggaggguuugucaggcgcgacguggguagauguugugcuggaacacgggagcugccuacacacuauggcacaaaauaaacccacacucgacauugagcugcuuaagaccgaagucacuaacccugccgugcugagaaaauuguguaucgaggcuaagauaaguaauacaaccacggauuccaggugcccaacccagggagaagccacacucguggaggagcaggacgcaaacuucgucugucggcgcacuuuuguugaucgaggcugggguaaugggugcggacuguucggcaaaggcucuuuacugaccugcgcuaaguuuaagugugugacaaaacucgaagggaagauuguacaguacgagaaccuuaaauauagcgugaucgucacugugcauaccggagaccaacaccagguugguaaugaaacaaccacucauggcacgauugccacaaucacaccccaggcgccuacuuccgagauccagcugaccgauuacggggccuugacacuagacugcucaccaagaaccggacuggacuucaacgaaauggugcuccugacuaugaaggagaaaaguuggcuuguccacaagcaaugguuucuggauuugccgcuccccuggacaagcggcgcaucuacgucccaggagaccuggaauaggcaggaccuguuagugacuuucaaaacagcucacgccaagaagcaagaaguaguugugcuggguucacaggagggggcuaugcauaccgcccuaacaggcgcaacugaaauucagaccagcggaacgaccacaauauuugccggccaccucaaaugucggcugaagauggauaaacuuacuuugaaggggaugaguuaugucaugugcaccggaucuuucaaacuggagaaggaaguggcugagacacagcaugguacuguccucgugcaaguuaaguacgagggcaccgacgcgccuuguaaaaucccauucuccacgcaggaugaaaagggggugacacagaacggacgucugauuaccgcaaaucccaucguaacugacaaagagaagccugucaacauagaagccgagccacccuuuggcgagagcuauauugugguuggugcuggggaaaaagcccuuaagcugucgugguucaagaaaggaucuuccaucggaaagauguuugaggcaacagcccgcggcgcuagaaggauggccaucuugggggauaccgcaugggacuucggaucaauugguggcguguuuacaagugucgggaaacucgugcaccagguauucggaaccgcguacggcgugcuguuuagcgguguuuccuggaucaugaagauugggauaggcaucuuacugacauggcuaggacucaauucucggagcacgucacugaguaugaccugcauugcugucggcauggugacucuuuacuugggggugaugguccaagccgauuccggauguguuaucaacuggaaaggccgagaacugaagugcgguagcgggaucuucgugacaaacgaggugcauaccuggacagaacaguauaaguuucaggcagacucuccgaaacgccucucagccgcuauuggaaaggccugggaggagggcguaugugguauaagaagugcaacuaggcuggaaaauaucauguggaaacagauuagcaacgaguuaaaucacauccugcuugaaaacgauaugaaguucaccgucgugguuggcgacgcuaaugggauuuuggcccaaggcaagaaaaugauccggccucagcccauggagcacaaauacuccuggaagucuuggggcaaggcgaaaauaaucggggccgacauucagaacacgacauuuaucauugauggaccagacaccccugaaugccccgaugaccagcgcgcuuggaauaucugggagguggaggauuauggcuucgguauauuuacuaccaacauuuggcucaagcugagagacucguacacacaaaugugugaucauaggcuaaugagcgcagccaucaaagacuccaaggcuguccacgccgauaugggguauuggauugaaucagagaaaaaugaaacuuggaagcuggcacgugcgaguuucaucgaggugaagaccugcauauggccaaaaucucauacacucuggagcaacggaguucuggaauccgagaugaucauucccaagaucuacggcgguccuauuucacagcacaauuaucggccaggcuacuucacgcagaccgccgggccguggcaccuuggaaaauuggagcuggacuuugauuuaugcgaaggcacuacagugguagucgaggaacauugugggaaccgaggacccagccucagaaccacuacagugaccggcaagaucauacacgaguggugcuguaggucuugcacgcugccuccacuucgcuucaaaggugaggacggguguugguacggaauggaaauucggcccgugaaggagaaggaagagaaucuggucagauccaugguuagugcuggcagcggugaaguggauucuuuuuccuugggccuccugugcguaucaaucaugaucgaggaggugaugaggagucgcuggagccgaaaaaugcuaaugacugggacccuggccgucuuccuccugcuuauuaugggacaauugacauggaacgaccugauccgguuauguauuauggugggcgcaaaugcuucggaccguauggggaugggaaccacuuaucucgcccugauggcaacauuuaagaugagaccuauguucgccguuggccuucuguuuaggcgccuaaccucccgggaagugcuccuguugacaauaggucugucuuuagucgcuagcguggagcucccaaacucacuggaagaacuuggggauggacuggcgaugggcaucaugauguugaaacuccugacugacuuccagagucaucagcuauggaccacgcugcuuucccucacauuuauuaagaccacucugucuuuggauuacgccuggaaaaccauggcaaugguucugagcaucguguccuuauucccccucugccugucaacaacuagccagaagaccacguggcuuccgguccuguugggcaguuuuggguguaagccucucacaauguuccugauuaccgaaaacaaaaucuggggaagaaagucuuggccacuaaaugaggguauaauggcuguaggcaucguguccauucugcuuagcucgcuccugaaaaacgacguucccuuggccgggccuuuaaucgccggaggcaugcugauuucauuuuucgugaucucugguaguuccgcugaucucagccuggagaaggcagccgaagucucuugggaggaagaggcggaacacagcgggacuucccauaauauacuuguggagguacaagacgauggaacaaugaaaauuaaggacgaggaaagggaugacacccugacuaucuugcuaaaagcuacacugcucgccgugucaggcgucuaucccaugaguaucccagcaacccuguucguuugguacuuuuggcagaagaagaaacagcgaagcggcgugcuuugggauacgccuucucccccagagguggaacgcgccgucuuagacgaugggauuuaucggauacugcagagaggacucuuggguaggucccaagugggcguugggguauuccaggacggaguguuucacacuauguggcacgucacccguggcgcugugcugauguaccaggguaagcgccucgagccgucaugggcaaguguuaaaaaggaccugaucagcuaugggggaggcuggcgguuccagggcuccuggaacacaggggaggaagugcaagucauugccguggagccuggcaagaaucccaagaacguacagaccacaccagguacuuuuaagacccccgaaggcgaggucggggcgaucgcucuugauuucaaaccuggaacgucuggcucgccaauugugaauagagaagguaagaucguugggcuguacggaaacggcguggucacaacuagcggcaccuacgugucagccauagcacaggccaaggcuucccaagaggggcccuugccugagaucgaagacgagguuuuuaggaagcgaaaucuaacaauuauggaucugcauccgggaagugguaaaacccggcgcuaucucccagccaucgugagagaagcaauuaagaggaaguuacggacucugauccuugcucccacccgagucguggccucugagauggcggaagcccugaaaggcaugccuauaagauaccagacaacggcaguaaagagcgagcacacugggcgcgagauuguggaccucaugugccaugcuaccuucacaaugagguugcuguccccaguucguguccccaacuauaauaugaucaucauggaugaagcccacuuuaccgacccugcuucaauugcagcccggggauacaucucuacuagagugggcaugggugaggccgcugcgauauucaugacagcaaccccgcccgggagcguggaagccuuuccacagaguaacgcugucauucaggaugaggaaagggacaucccugagcgcuccuggaauagcggauaugauuggauuacggacuuccccggcaaaacuguaugguucgugccaucuaucaagucaggcaacgauauagccaauugucuccggaaaaacgggaagagaguuauucaacuguccagaaagacauuugacaccgaguaccagaaaaccaagaacaaugacugggauuauguggucacuacagacaucagugaaaugggagcaaacuucagggccgaucgcgugaucgacccucguagaugccuuaaacccguuauucuaaaggaugguccagagcgggugauccuggcuggcccgaugccugucaccguggcgagcgccgcacagaggcgcgggcgaauuggaagaaaucagaacaaagaaggcgaccaauacguaaauaugggucagcccuugaacaaugaugaggaccaugcucacuggacagaggccaagauguuacuggauaacauaaauacuccagaagggaucauucccgcacucuuugagccugaacggaagaaaucggccgcuguggacggcgaguacaggcugcgcggagaagccagaaagacguucguugagcuuaugaggcggggcgaucugccagucuggcucucuuauaaaguggcguccgagggguuucaguacagcgaccgucgcuggugcuucgauggagaacgaaacaaucagguguuggaggaaaacauggacgucgagaucuggaccaaggaaagagagaggaaaaagcugcggccccgcuggcuagacgcaagaacauauucagauccucuggcccucagggaguuuaaagaguucgcugccggucggcgaaguguuucuggcgaccuuauccuggagauugggaaguuaccgcaacacuugacucugagagcucagaaugcacucgauaaccuggugaugcuucauaauuccgaacagggaggcaaggccuaccgccacgcuauggaggaacugccagacaccauagagacacucauguugcuggccuuaaucgcaguacuaaccgguggggugacucuguuuuuccucagcggcaaaggacuuggcaagacgucaauugggcuguugugugucauggcgaguagcgcccugcucuggauggcuuccguggagccccauuggaucgccgcaucuauuauccuggaauuuuuccuuaugguucuccugauaccugagcccgauaggcagcggaccccacaagacaaccaguuggcuuauguggucaucggacuguuauuuaugauucuaacaguagccgcaaacgaaaugggucugcucgagacuaccaaaaaggaucuuggcaucgggcacguggccgcugagaaucaccaucacgcgacaaugcuggacguugauuugcguccugccagcgcauggacccuguacgcuguggccacuacaauuaucacgcccaugaugagacauaccauagaaaacacuacagccaauauuucccucaccgcaaucgcuaaccaggccgcgauucugaugggacuugacaaaggcuggccaaucucauuaauggauauaggugucccucugcucgcuuuggggugcuauucucaagugaauccgcugacccuaacagccgcaguccugaugcucguggcccacuacgcuaucauuggccccggacuucaggcaaaggccacuagggaggcgcagaagcgcacggcugccggcaucaugaaaaacccaaccguugacgggauuguggcaaucgaucuggacccuguaguguacgacgccaaguucgaaaaacaguugggacaaauaaugcugcucauucuguguacaagucagaucuuacuuaugcggacuaccugggcucugugcgagucgaucacacucgccaccggcccccuaacuacgcugugggaagguagcccagggaaguucuggaauacaaccauugcagucuccauggcuaacaucuuucgaggaucuuauuuggccggcgcgggucuggccuucucacucaugaaaagccuuggcgggggaagaaggggcacuggggcacagggagagacccugggcgagaaguggaagcgccaguugaaucaacuguccaaaagugaauuuaacauauacaagcggucugguauuauggagguugauagaagcgaagcuaaagaggggcucaagcguggagaaacaacuaaacaugccgugucaaggggcaccgcaaaguuacggugguucgucgagcgcaaucuggugaagccugaggguaaaguaaucgaccuuggcugugggcgaggaggcugguccuauuacugcgcugggcugaagaaagugacagaaguuaagggauauacgaaaggcggucccgggcacgaggaaccgauuccaauggccaccuacggauggaaccuagugaagcuccacaguggcaaagaugucuuuuucacuccucccgagaagugugacacacuguugugcgauaucggcgaaagcucuccaaaucccaccauagaggaggggagaacucugagggugcucaagauggucgaaccuuggcuucggggaaaccaguuuuguaucaaaauucugaauccguauaugcccuccgugguugagacauuagaacagaugcagcgcaagcaugguggcaugcugguaagaaacccauugucaaggaauagcacccacgagauguacugggugucgugcgggacgggaaacaucgucucugccgugaacaugaccagucgaaugcuccugaaucgguucacaauggcgcaucguaaaccuacuuacgagagagacguugaucuaggcgcugguacccgccacguggcagucgaacccgagguggccaaccuugacauuaucgggcaaaggauugaaaauaucaagaacgagcacaaauccacauggcauuaugaugaagacaauccuuacaagacuugggcuuaucacggaagcuacgagguaaagccaucaggcuccgccucuagcauggugaacggcguuguccggcugcucaccaaacccugggaugugauaccuauggugacacagauugcaaugaccgacacuacgccauuugggcagcaaagagucuucaaggagaaaguugacacacgcacccccagggccaagcgaggaacugcucagaucauggaagugaccgcgaaauggcuguggggauuuuugagucggaauaagaagccgagaaucuguacaagggaggaguucacgcgcaaaguacguuccaacgccgcaaugggcgcuguguuugucgaugagaaucaguggaacagcgccaaggaagcaguggaggacgagcgguucugggaucugguucauagagaaagggagcuccacaaacaggggaagugcgcaaccugcguguauaauaugaugggaaaacgcgaaaagaaacuuggcgaguucgguaaagcuaaggggucucgagccauuugguacauguggcugggagcgcgguuuuuagaguucgaggcacugggcuuuaugaacgaggaccauugguucucaagagaaaauaguuuguccggcgucgagggggaaggacuccacaaacuggguuauauacuaagggauaucagcaagauuccuggcgggaacauguacgccgacgauacugcuggaugggacacacgcaucaccgaggaugaccuucaaaaugaggccaaaauuacugauaucauggaaccagagcacgcacugcucgcuacaucuauauuuaagcugaccuaccagaacaaagugguaagaguucagcggcccgccaagucgggcacagugauggacgucaucucaaggcgugaucagcgagguagcgggcaagugggaacuuauggcuugaacaccuucacgaauauggaagugcaguuaauucgccagauggaguccgaaggcaucuuucugccuagugagcucgagaccccaaaccuugcugaaagaguccuggacuggcuagagaagcauggggccgaacggcugaaaaggauggcaauuucuggagacgauuguguugugaagcccaucgacgaucgcuucgcgacagcccucacugcuuugaaugacauggguaaaguaagaaaggauauaccgcagugggagccuagcaaaggcuggaacgacuggcaacaggugcccuuuugcucccaccauuuccaccagcugauuaugaaggaugggcgggaaaucgucgugccauguaggaaucaggacaaacuuguuggacgagcccgugugucacaaggcgcagguuggagucugagagagaccgcuugccucgggaaaucuuacgcccagauguggcaguuaauguauuuucaccgccgggaucugagguuggcagccaacgcgaucuguagcgcugucccuguggacuggguacccacauccagaacuaccuggucaauucaugcccaccaucaauggaugacgacagaggauaugcugagcguuuggaauaagguguggauagaagagaacccauggauggaagacaaaacccacgucucuuccugggaggacgugcccuaccucggaaagcgcgaagaucaguggugcggcagucuuaucggccugacugcacgggccacaugggcuaccaauauucagguugccaucaaccaggugaggcgacuaauugggaaugagaacuaucuggacuacaugacuagcaugaaaagauucaagaaugagucggauccugaaggagcacucugguga

SEQ ID NO: 13254 - RNA, 9879 nt, Artificial Sequence
  derived and/or modified CDS sequence (opt3) from DENV-1__JQ922546__SS-prME
agcguggccaugcugcucaugcuucugcccaccgcuuuggcauuccacuuaacaacuagaggcggggagccucauaugaucgucuccaagcaggaaaggggaaaaucucugcuauuuaagacgucagccgguguuaacaugugcacccucauugcgauggaccugggcgagcuuugugaagauacaaugacuuacaaauggccacggauaaccgaggcugaaccggacgauguggacugcugguguaaugccacagauaccuggguaacuuaugggacaugcagucaaaccggagagcaccgccgagacaagcguagcguggcacuggccccccaugucggcuugggucucgagacgagaacugaaaccuggauguccucugagggggcuuggaaacagauccagaagguggaaacaugggcacugaggcacccuggauucacuguuauugcccuguuucucgcucaugccaucggcaccucgauuacacagaagggcaucauauucaucuuacugaugcuugugaccccaucaauggcgaugcggugugucgggauuggaaaccgcgauuuuguggaggguuugagcggcgcaacguggguagacguugugcuggagcacgggaguugcgucacuacaauggccaaaaauaagcccacccuagauaucgaacuccugaaaacugaggugacaaacccugcugugcuuagaaagcuguguauugaagccaaaaucuccaauaccacgaccgacucuaggugcccaacacaaggagaggcaacuuuggucgaagagcaggaugcuaacuucguuugucggcgcaccuuuguggaccgaggcugggguaaugggugcggacucuucggcaagggcagccuguuaacaugugccaaguuuaaaugcguaacuaagcuggaggggaaaauagugcaguacgaaaaccucaaguauuccgucauugugaccguucacacaggagaucagcaucaaguggguaaugagaccacugaacacggcacgaucgcgauuaucacaccccaggccccuaccucagagauccagcuuacugacuacggggcacugaccuuggacugcaguccaagaacaggacuagauuucaacgaaaugguccugcucaccaugaaagagaagagcuggcuggugcauaaacagugguuucuugaccugccguugcccuggacuucuggcgcuuccacaucacaagagacguggaauaggcaggaucuccugguaaccuucaagacugcccacgcuaagaaacaggaaguuguggucuuagguagccaagagggggccaugcacacagcacugaccggcgccacagaaauucagacuaguggaaccacgaccauauuugcuggccaucuaaagugucggcucaaaauggacaagcugacacuuaaagggaugucuuaugugaugugcacuggauccuucaaguuggagaaggaagucgcggagacccagcacgguacagugcugguucaggugaaauacgagggcacugaugcaccuuguaagaucccauucagcauucaagacgaaaaagggguaacccagaacggacgucucaucacggccaaucccauagucacagauaaggagaaaccugugaacauugaaaccgagccacccuuuggcgagucguauaucguugugggugcuggggaaaaggcccugaagcuuucuugguucaaaaagggcuccucaaucggaaaaauguuugaggcaacugcccgcggcgcuagaaggauggccauucugggggacacagcaugggauuucggaaguaucgguggcgucuuuaccagcguggggaaguugguacaucagguguucggaacugcguacggcguucucuuuuccggugucucuuggaccaugaaaauugggauaggcauccuguuaacauggcugggacuaaauagccggucaacgagucucuccaugaccugcauugcugugggcauggugacucuguaccuuggggucaugguucaggccgacagcggaugugugaucaacuggaagggccgagaauugaagugcgguucugggaucuucgugacaaacgagguacacaccuggacagaacaauauaaauuucaggcagauucaccgaagcgccugagugccgcuauuggaaaagccugggaggagggcgucugugguauaagaagcgcaacuaggcucgaaaaugugauguggaagcagaucuccaacgagcugaaucauauuuuacuggaaaacgacaugaaauucaccguuguggucggcgacgugaaugggauccuugcucagggaaagaaaaugauucggccucaacccauggagcacaaguacucuuggaagucguggggcaaagccaagaucauaggggcggauauccagaacacgacauuuauuaucgacggaccagauaccccugaaugccccgacgaucagcgcgccuggaauauuugggagguugaggacuauggcuucgguaucuuuacuaccaacauaugguugaaacucagagauagcuacacacaggugugugaccacaggcugauguccgcugcaauuaaggauucaaaagccguacaugcugacaugggguauuggaucgaaagugagaagaaugaaacuuggaagcuagcccgugcaucuuucauugaggucaaaaccugcacauggccaaagagccacacgcugugguccaacggagugcucgaaucagagaugaucauacccaaaaucuacggcgguccuauuagccaacauaauuaucggccaggcuacuucacccagacugcggggccguggcaccugggaaagcuugaguuggauuuugaccugugugaaggcacaaccguggucguugaugagcacugcgggaaccgaggacccucuuuaagaacuacaaccgugacgggcaaaaucauucaugaauggugcuguagguccugcacucucccuccacugcgcuucaagggugaggacggguguugguacggaauggagauccggcccguaaaggaaaaagaggaaaaucuugugagaaguauggucagcgccggcucuggugagguggacuccuuuucacugggcuugcucugcguuaguauaaugauugaagaggugaugaggagccgcuggucgcgaaagaugcugaugaccgggacacuagcugucuucuuucugcucaucaugggacagcugaccuggaacgaucuuuuccgguuguguaucauggugggcgccaaugcauccgaccguauggggaugggaacuacauaucuggcuuuaauggccaccuuuaaaaugagaccuauguucgcaguuggccuccuguuuaggcgccuuacaucucgggaggugcugcuacucacuauuggucugagcuuggucgccucaguagaacugccaaacaguuuagaggaacucggggauggacuggcuaugggcaucaugaugcuuaagcuguugaccgacuuccaaucccaccagcucuggacgacacugcuaucucugaccuuuauuaaaacuacccuuagccucgauuacgcguggaagacaauggccauggugcuguccauaguuucauugagcccccugugcuuaaguacuaccucucagaagacgacauggcucccggugcugcuuggcuccuucggguguaaaccucugaccauguuuuugaucacugagaacaagauuuggggaagaaaaagcuggccacucaaugaagguaucauggcagucggcauugugucgauccugcuaucaucucugcuuaagaacgacguaccccucgcugggccucugauagccggaggcauguugaucgccugcuaugugauuagugguuccagcgcugauuuaucucuggagaaagcagccgaggucagcugggaagaggaagcggagcauuccggggcuucacacaauauccucguugaagugcaggacgauggaacaaugaagauuaaagacgaggagagggaugacacccugacuauccuucugaaggccaguuugcuagcagugagcggcgucuaccccaugucuauaccagccacacuguucgugugguauuucuggcaaaagaaaaagcagcgauccggcguucucugggauaccccuucacccccagaaguagagcgcgcugugcuggacgacgggauuuaccggauccuucagagaggauuacuggguaggagucaggucggcguggggaucuuucaagauggaguuuuccauacgauguggcacgugacucguggcgcaguccucauguaucaggguaaacgcuuggaaccgagcugggccuccgugaagaaagaccugauuucuuacgggggaggcuggcgguuucagggcucguggaacaccggggaggagguacaggucauagcgguggaaccuggaaagaaucccaagaacguucaaacaaccccagguaucuucaaaacacccgagggcgaagugggggcuauuacucucgauuuuaagccuggaaccagcggcucaccaaucgucaauagagaggguaaaauuguggggcuguacggaaacggcguugugacgacauccggcacuuaugucagugccaucgcacaggccaaggcuucucaggaagggccccuuccugagauagaggacgaaguguucaggaaacgaaaucugaccaucauggauuugcacccgggaagcgguaagacacggcgcuaccuaccagccauuguaagagaggcaaugaagaggaaacugcggacccucaucuuagcucccacucgagugguugccuccgaaauggcggaggcccugaagggcaugccuauuagauaucaaaccacagcagucaaaucagaacauacggggcgcgagaucguggaccuuaugugucacgcuacuuuuaccaugaggcugcucucuccagugcguguccccaacuacaauaugauaauuauggaugaggcccauuucacagacccugcuagcaucgcagcccggggauauaucaguaccagaguaggcaugggugaagccgcugcgauuuuuaugacugcaacaccgcccggguccguggaggccuucccacagagcaacgcuguuauccaggaugaagagagggacauaccugaacgcucuuggaauucaggauacgauuggauuaccgacuuucccggcaagacggugugguucgucccauccaucaaaaguggcaacgacauugccaauugcuugcgaaagaacgggaagagagugauccagcugagccggaaaacuuucgauacagaguaucaaaagaccaaaaacaaugacugggauuacguugugaccacugacauaucggagaugggagcaaacuuuagggccgaucgcgucauugacccucguagaugucucaagcccgugauccugaaagaagguccagagcggguaauccuugcuggcccgaugccugugacaguugcgucugccgcacagaggcgcgggcgaauuggaagaaaucagaacaaggaaggcgaucaguacgucuauaugggucaaccccuaaauaacgacgaggaucacgcucauuggaccgaggccaagaugcuguuggaccacaucaauacaccagaagggauuauacccgcauuauucgagccugaacgggagaaauccgccgcuaucgauggcgaauacaggcugcgcggagaggccagaaagacuuuuguggagcucaugaggcggggcgaccugccaguguggcuuagcuauaaagucgcgucagaaggguuccaguacacggaucgucgcuggugcuuugacggagagcgaaacaaucagguucuggaagagaacauggacguggaaauuuggauggaggagggugaaaagaaaaagaucagacccagguggcucgagaucgaaaaauauagugauccuuuggcacugcgggaguucaaggaauuuucugccaagcgcaaauccguacuaggcgaccugaagcucgagauugggaaacuuccgcagcaccugaccauaaaggcuagaaaugccuuagauaacuuggugaugcugcauaauagcgagcaaggaggcaaagcuuacaggcacgcaauggaagagcucccagacacaaucgaaacucugaugcggcuuggucugauugccgucaugaccgggggcgugacacucuucuuuuugucaggaaagggccuggggaagaccaguaacggauuacuaugcguuauggcuagcuccgugcugcucuggauggccucugucgagccccauuggaucgcagcgagcauuauccuugaguucuuucugaugguauugcugauaccugaacccgaucgacagagaacuccacaggacaaucagcucgccuaugugguuaucggucugcuuuucaugauucucacgguggcugccaacgagaugggccuguuggaaaccacaaaaaaggaucuggggaucggacacgucguggcagagaaccaccaucacgcuacuauguuagacgucgaucuacauccugccuccgcauggacccuguacgccguggcuacaaccauuaucacucccaugaugcgccacacaauagaaaauacgaccgcgaacauuucacucacugccaucgcaaaucaagcugccauucuuaugggccuggacaaagguuggccaaucucuaagauggauauagggguuccuuugcuggcccucggcuguuacagucaggugaacccgcugacacuuaccgcagcuguauuaaugcugguggcccauuaugcgaucauuggacccggccuccaggcuaaagccaccagggaggcacaaaagcggacagccccacagaucaugaagaaucagauugucgacgggaucguugcuguggauuuggacccugucguguacgacgcaaaauuugagaagcagcugggacaaauaaugcuacugauucucugcacuucgcagauccuucugaugcguacgaccugggccuugugugaaagcaucacacuggcgacuggcccccucaccacacugugggaggguuccccagggaaauucuggaacaccacuauugcuguaucuauggccaauaucuucagaggaucauauuuagcaggcgccggucuugcuuuuagccugaugaagucccucggcgggggaaggcgcggcacgggggcccagggagaaacacuaggcgagaaauggaagcggcagcugaaccaauugaguaagucugaauucaauaccuacaaacgaagcgguauaauggagguggauagaucagaggcaaaggaagggcugaaaaggggagagacuaccaagcacgcuguuucccgcggcacagccaaacuccggugguuuguggaaagaaaccuugucaagccugaggguaaagugauugaccugggcugcgggcguggaggcuggaguuauuacugugcgggguugaagaaggucacugaagugaaaggauauaccaagggcggucccgggcacgaggagccgaucccaauggccacauacggauggaaucugguuaaacuccauagcggcaaggauguauucuuuacgccucccgaaaaaugcgacaccuuacugugugauauuggcgagucuuccccaaaccccacuaucgaagaggggaggacacuucgggugcugaagauggucgagccuuggcuacgcggaaaucaguucugcauaaagauccucaacccguacaugcccucagugguugaaacccuggagcagaugcagcgaaaacacgguggcauguuggugagaaauccacugagcaggaacucgacucaugaaauguauugggucucuugugggacaggaaauauugugagugcaguaaacaugaccucccggaugcuccuuaaccgcuuuacgauggcucacagaaagccuaccuacgagagggacguggaucugggcgccgguacacgacacguugcagucgaacccgagguggcuaauuuagacaucauugggcaacggaucgagaacauuaaaaaugaacauaagagcacuuggcacuaugaugaggacaacccuuacaaaaccugggccuaucauggaucauacgaagugaagccauccggcucugccagcaguauggucaauggcguugugcgucuguugacaaagcccugggauguaaucccuacugugacccagauagcgaugacagacaccacuccauucgggcagcaaagagucuuuaaagagaagguggacacgcgcacacccaaagcuaagaggggaaccgcacagauuauggaaguuacugccaacuggcucugggguuuccugucccggaauaaaaagccgagaaucugcacccgcgaggaguuuacaaggaaggugcgaagcaacgcugccaucggcgcagucuucguggaugaaaaucaguggaacucugccaaagaggcuguagaagacgagcgguuuugggaucuaguucacagagaaagggagcuucauaagcaggggaaaugugcgacgugcguguauaauaugaugggaaagcgcgagaaaaagcugggcgaauucgguaaagccaaggggucacgugcaauuugguacauguggcucggagcucgguuccuggaguuugaagccuugggcuucaugaacgaggaccacugguuuaguagagagaauucccugagcggcgucgaaggggagggacuccacaagcuugguuacauacugagggauaucucuaaaauuccuggcgggaacauguaugcagacgauaccgccggaugggacacucgcaucacagaagaugacuuacaaaaugaggcuaagauuaccgauaucauggaaccagagcaugcccuguuggcgacuucgauauucaaacucacauaccagaacaagguggugcgaguccagcggcccgcaaaaucaggcaccguuauggacgugaucagcagaagggaucagcgcgguuccgggcaaguaggaacauauggccugaacacuuuuaccaauauggaggugcagcuaauuagacagauggaaagugagggcaucuuccuuccuucugaacuggagacgccaaaccucgccgaacggguccugaauugguuggagaagcacgggguggagagguuaaagcguauggcuauuagcggagacgacugcguugugaaacccaccgaugaccgauuugccacagcacugacugcucucaacgauauggguaagguccgcaaagacaccccgcagugggaaccuuccaagggcuggaaugauuggcaacaggugcccuucuguucacaucacuuucaccagcuuaucaugaaagacgggagagagauaguaguuccaugccggaaccaggaugaacuggugggaagggcccgcgucagucauggcgcugguuggucucuaagagagacagccugucuggggaagagcuacgcacaaauguggcagcucauguauuuccaccggagggacuugcgacuggcggccaaugcuauuugcuccgccgugccuguugauugggugcccacuucacguaccacguggagcauccaugcacaccaucaguggaugacaaccgaagacaugcuuucugucuggaacagaguguggaucgaggagaauccauggauggaagauaagacucacguauccaguugggaggacgugcccuaccugggaaaacgcgaagaccaaugguguggcagcauuauaggccucacagcucgggccaccugggcaacuaacauccaggucgccauuaaucagguuaggagauuaaucgggaacgagaauuaucuggauuacaugaccucgaugaagcgcuuuaaaaacgaguccgacccugaaggagcguugugguga

SEQ ID NO: 13255 - RNA, 9879 nt, Artificial Sequence
  derived and/or modified CDS sequence (opt3) from DENV-1__JQ922545__SS-prME
agcgugaccaugcugcucaugcuucugcccaccgcauuggcuuuccacuuaacuacgagaggcggggagccucauaugaucgucuccaagcaggaaagggggaaaucucugcucuuuaagaccucagccgguguuaacaugugcacgcucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccauacaaucggcaccucgauuacgcagaagggcaucauauucaucuuacugaugacuggggcuccaauuauggccaugcgcugcgugggaaucgguaacagagauuuugucgagggccuuucaggggcgcccuggguggacguaguuuuggagcacggaagcugucugaguaauauggcaaagaacaaaccuacacuagauauugacuucuuuaagaccgaagugacuaauccagccguccucaggaaacugugcaucgaggcuaagauauccaacacaaccacggauucucggugucccacccaaggcgaagccacacuuguggaggaacaggacgcaaauuucgugugccgccgaacuuuugucgauagagguugggggaacggauguggccuguucggcaaagggagcuugcuaaccugcgcuaaguuuaagugcguuacaaaacuggagggaaagauugugcaguacgagaauuuaaaauauuccguaaucgugacuguccacaccggugaccagcaucaagugggcaacgaaacaaccgagcacgggacuauugccacgaucacaccucaggcgccaaccucagaaauccagcugacugacuacggagcccucacccuugauuguaguccgaggacaggccuggacuucaaugagaugguuuugcuaaccaugaaggaaaagagcuggcuggugcauaagcagugguuucucgaucugccccuuccuuggacuucuggugcauccacaucacaagagacguggaaccggcaggaccuguuggucaccuucaaaacugcucacgccaagaagcaggaggugguaguucucgggagccaagaaggcgcuaugcacacagcccugaccggagcaacagagauucagaugaguggcacuaccacgauauucgccgggcauuuaaaaugccgucugaagauggauaaacuaacccucaagggagugucuuaugucauguguacagguuccuuuaaacuggaaaaggagguggcugaaacucagcacggcaccguccuugugcagguuaaguacgaggggacagacgcgccaugcaaaauccccuucagcacucaagaugagaagggagugacccagaauggccgcuugauuacggcaaacccuaucguaacagacaaagaaaagccagucaauauagagaccgaacccccguuuggugagucguauauugugaucggggccggcgagaaagcucugaagcucucuugguucaagaaaggauccucaaucggcaagauguuugaagccacugcaagaggggccaggcggauggcuauucugggagauacagccugggacuucgguaguaucggcgggguuuuuaccagcgugggaaaacuuguccaucagguguucggcacugcauacgguguacuguuuuccggggugucuuggaccaugaagauuggcauaggaaucuugcucacauggcugggcuuaaacagccgaucaacgagucuguccaugaccuguauugcgguugggauggucacucuauaccucggagugauggugcaggcugauagcggcugcgucaucaacuggaaaggucgcgagcugaagugugggucuggaaucuucguuacaaaugaagugcacaccuggacagagcaauauaaguuucaggccgacucaccuaaaagacuuagugcagccauuggcaaggcuugggaagagggugugugcggcauaaggagcgccacuuguuuggagaacaucauguggaaacagauuuccaaugaacugaaccauauccuccuggagaaugacaugaaguucaccguagucgugggggaugcaaacggaauuuuaacgcagggcaaaaagaugauccggccccaaccaauggaacacaaauacucuuggaagucgugggggaaggcuaaaauaaucggagccgacauucagaauacaaccuuuaucauugauggcccugacacucccgagugcccagaugaccagcgcgcguggaacaucugggaaguugaggauuaugguuucgggauauucaccacaaauauuuggcugaaacuuagagacagcuacacucagaugugugaucacagguugauguccgccgcuaucaaagacucaaaggcagugcaugccgauaugggauauuggauugagagugagaaaaacgagaccuggaagcucgcucgugccucuuuuaucgaagucaagacaugcauauggccccggagccacacgcugugguccaauggcgugcuagagucagaaaugaucauuccuaaaaucuacgguggcccaauuagccaacauaacuaucgaccgggguacuucacccagacugcaggacccuggcaccugggcaagcucgagcuggacuuugaucuuugcgaggggacaaccguugugguagacgaacacuguggaaauagaggcccuucuuugaggacuacaaccgucacggguaaaaucauacaugaguggugcugucgcuccugcacucugccacccuuacgguucaagggggaagacggauguugguacggcauggagauuagaccugugaaagagaaggaagagaaccucgugaggaguauggucagcgcggguucuggcgaaguugauuccuuuucacuggggcuucugugcgugaguaucaugaucgaggaaguaaugcgcagccgauggucgcggaagauguugaugaccggaacacucgccguguucuuucugcuaauuaugggccagcugaccuggaaugaccucauccgucuguguauuauggucggggcuaacguguccgauagaaugggaaugggcacuacauaucuugccuugauggcaaccuucaaaaugaggccaauguuugcuguuggucuguuauuccgccggcucacaucuagagaggugcugcuucugacuauagggcuaagccucgucgccucaguggagcugcccaacaguuuggaggaacugggagacggcuuagcaaugggcaucaugaugcucaagcugcuuaccgauuuucaaucccaccagcuguggacgacauugcucucucugaccuucauuaaaacuacccuaagccuggacuacgccuggaagacaaucgcuaugguucuuuccauugugucacucuuuccgcugugcuugagcacuaccagucagaaaacgacauggcugccugucuuacucgggucuuucggauguaagccacugaccauguuccuuaucacugaaaauaagauaugggguaggaaauccuggccccugaacgagggcaucauggcgguagggauugugagcaucuugcucucgucacugcuaaagaaugauguuccucuggccggaccccuuauugcaggcgguaugcucaucgcuugcuaugugauaucugggaguuccgccgaccugagcuuggaaaaagccgcugaggucucuugggaggaagaggcacagcauagcggagccucccacaacauuuuaguggaaguacaagaugacggcacaaugaagaucaaagaugaggaacgagacgauacccugacuauccuccugaaggcgacacuucuggcugugucaggcgucuacccaaugaguauuccugccaccuuguuuguuugguauuucuggcagaaaaagaagcagcgcagcggggugcuaugggacacgcccucuccaccggagguggagcgggcaguccuggacgauggaauauacagaauccuccagaggggucugcuuggccguucccaaguggggguuggaguauuucaggacggcguguuccauacuauguggcacgucacccgcggugccguguuaauguaucaggggaaacggcuggaaccuucaugggcuaguguuaagaaagaucucauuagcuacggaggcggcuggagauuucagggguccuggaauacaggagaggaagugcaagucaucgcaguggagcccgguaagaaccccaaaaauguacagaccacacccggcacuuucaagaccccugagggggaagucggagccauugcguuggacuuuaagccaggcacgucugguucgcccaucgugaacagggaggggaaaauaguuggacuguacggcaauggcguggucacaacuagcgggaccuaugugucagcuaucgcccaggcaaaggccucccaagaaggaccucucccggagauugaagaugagguuuucaaaaagcgaaaccugacaaucauggaccuucacccagguaguggcaaaacccggcgcuaccugcccgcuauugugagagaggccaucaagaggaaguugcggacucuaauacuggcaccuacccgagucguggcuucugaaauggccgaggcgcucaaagggaugccaauuagauaucagacaacggccguaaagagcgaacauacuggacgcgagaucguggauuuaaugugucacgcaaccuuuacaaugaggcugcuuucccccguucgugucccuaauuacaacaugaucauuauggacgaagcucauuucaccgauccggccucaaucgcugcacggggcuauauaucuacuagaguggguaugggggaggccgccgcuauuuuuaugacagcgacaccaccaggaagcguggaggcauucccucagaguaaugccgucauccaggacgaagagagggauauucccgaacgcuccuggaacagcggcuacgacuggaucacggacuucccaggcaaaacuguaugguuugugccuucuauaaagucaggguccgauauugcuacaguucuggagcgaaguagagaacccgugauccaacucagccggaaaaccuucgacaccgaguaucagaagacuaagaauaacgauugggacuacgucgugacaaccgauaucucggagaugggagccaacuuuagggcagaccgcguuauugauccacguagaugcuugaaaccggugaucccuaaggacggucccgaacgggucauucuggccggcccaaugcccgugacaguagcuucugcggcccagaggcgcgggcgaauaggaagaaaucagaacaaagagggcgaucaauacaucuauaugggucagccucucaauaacgacgaagaucacgcacauuggacugaggcuaagaugcugcuugacaauauuaacacgccagaggggaucauccccgcccuauucgaaccugagcgggaaaaauccgcagccauugauggcgaguacaggcugcgcggagaagcuagaaagaccuuuguggaguugaugaggcggggcgacuuaccgguuuggcugagcuauaaggucgccucagagggguuccaguacagugaccgucgcuggugcuuugauggagaacgaaauaaccaggugcucgaggaaaauauggacguggagauauggacaaaagaaggugagagaaagaaacugaggccacgguggcuugaugcgcgcacuuauucugacccccuggcacucagagaguucaaggaauuugccgcuggcaggcgguccgucagcggggauuugauccuggagauugaaaaacuaccucaacaccugacccuccgagcccagaacgcucuugacaaucugguuauguuacacaacucagagcagggaggcaaggcauacagacaugccauggaagaguugcccgauacaaucgagacccugaugcuccuggcucuuauugccgugcugacuggugggguaacacucuucuuuuugaguggcaaaggacugggcaagaccagcaucggguuacuaugugugauggcauccucuguccugcucuggauggcgagcguggaaccacacuggauagccgcuuccaucauucuugaguucauccugaugguuuugcugauuccugaacccgaccgccagaggacaccacaagauaaucagcucgccuauguggucaucggacugcuuuuuaugauacucacuguagcagcuaacgagaugggucuguuggagaccacaaagaaagaccugggcauugggcaugugguugccgaaaaucaccaccaugcaaccauguuagauaucgaccuacacccugccucagcuuggacucuguacgcgguggccacaacgauuaucaccccgaugaugcggcauacuauagagaacacaaccgcaaacaucucucucaccgcuauugccaaucaggccgcaauccuuaugggacuggauaagggcuggcccauuaguaaaauggacaucggugucccauugcuggcucucgggugcuacucgcaagugaacccucugacacuuacugccgcggucuuaaugcugguggcucacuaugccauaauuggccccggacuccaggcaaaggccacgcgugaagcucagaaaagaaccgcagccggcaucaugaagaauccaacaguugacgggaucguggcgauugauuuggacccuguaguguacgaugcuaaguucgagaaacagcugggacaaaucaugcuacugauacucuguacuagccagauucuucugaugaggaccacaugggccuugugcgaauccaucacccuggcaacuggcccccucacgacacugugggaggguucuccggggaaguucuggaacaccacuauugccgucucaauggcuaauaucuuucgcggaagcuauuuagccggcgcaggucuugcuuucucccugaugaaaagucucggcgggggacggcgaggcaccggggcccagggagagacacuaggcgaaaaguggaaaagacagcugaaccaauugucuaagagcgaguuuaauacuuacaagaggucagguauaauggaaguugaccgcuccgaggcgaaagaagggcugaagcggggagagaccacaaaacaugccgugaguagaggcacggcaaagcuccguugguucgucgagaggaaccuugugaaaccagaagguaagguaaucgaucugggcugugggcggggaggcuggagcuauuacugcgcuggguugaagaaagugaccgagguuaagggauauacuaaaggcgguccugggcacgaagaacccauuccaauggccacauacggauggaaucuggugaagcuccacucuggcaaagacgucuuuuucacucccccugaaaagugugauaccuuacugugcgacaucggcgaguccucaccgaaccccacaauugaggaagggcgcacccuucgagugcugaaaauggucgagccauggcuaagaggaaaucaguuuuguaucaagauucucaacccuuacaugcccagcgugguugaaacgcuggagcagaugcagaggaagcaugguggcauguugguacggaauccucugucgcgcaacucuacccacgagauguauugggugaguugcgggacaggaaauaucgucuccgcagugaacaugacuagcagaaugcuccuuaauagguucaccauggcucaucgaaaaccaacauacgaacgggauguugaccugggcgccgguacucgucacguggccgucgagcccgaaauagcgaacuuagauauuaucgggcaaagaaucgagaacauuaagauaggacacaaaucaaccuggcauuaugacgaagacaauccuuacaagacaugggcuuaucacggcuccuacgaggugaaaccaucuggcagcgcaaguuccaugguaaacggggugguucgccuguugaccaagcccugggaugucaucccgauggugacucagauugccaugacggacacaaccccuuuuggacagcaaaggguguucaaggagaaagucgauacucggaccccaagacccaagcgcgguacagcucagaucauggaaguuacggccaaauggauguggggcuuucucuucaggaaucgaccuccacggauuuguaccagagacgaguuugcaaggaaggugcgcagcucuacugccaacggggcuguauucguggaugaaaaucaguggaacucagcgaaagaggccgucgaagacgagcguuucugggaucuggugcaucgggagagagaacuacacaagcagggaaagugcgcaacaugcguuuauaauaugaugggcaaaagggagaagaaacuuggugaauuugggaaggcuaaaggaagucgcgccaucugguacauguggcugggcgcacgauuccucgaguuugaagcccugggcuucaugaacgaggaccauugguuuucccgggagaauagcuugucugggguggaaggagagggucugcacaagcucggcuacauacuuagagauaucucgaagauucccgggggaaacauguaugcugacgauaccgccggcugggacacuaggaucacagaagaugacucaagcaaugaggcgaaaauuaucgagcugaugcgcccggaacacgcauuacuggccaccuccauauucaaguugacauuucaaauuagugucgugagaguacagcggccugcuaaaucugguacuguuauggaguguaucagcaggcgugaccagaagcgauccggacaggugggaaccuacggccucaacacguucaccaauauggaaguccaacugauccgccagauggagucagaaggcauuuuuagucccucugagauggagaacagcaaucuagccgaaagagugcuugauuggcuggagaaacaugggguggaacggcucaagaggauggcaauauccggagacgauugcgucguuaaaccaacagacgaucgcuucgcuacugcccugaccgcuuugaacgacauggguaaggugagaaaggauaucccucagugggagcccucaaaaggcuggaacgacuggcagcaaguaccauuuuguagccaccauuuccaccaguuaauuaugaaggaugggcgggaaaucgugguccccugcaggaaucaggacgagcuggugggacgagcccguguuucucagggcgcagguuggucccucagagagacagcgugucuugggaaaaguuaugcccaaauguggcagcugauguacuuucaccgccgggaucuaaggcuggcugccaacgcaauuugcagcgcugugccugucgacugggugccaacuucgagaaccacgugguccauccaugcccaccaucaguggaugacaaccgaagacaugcucucuguauggaaucgcguuuggauagaggaaaacccguggauggaggauaagacucacgugucaagcugggaagacguccccuauuugggaaaacgggaggaucaaugguguggcagucugaucggccuuacagcaagggccaccugggcgacuaauauucagguggcuaucaaccagguucgaagacugauugggaaugagaacuaccucgacuauaugaccuccaugaagcgguucaagaaugaaucugauccugagggagccuuaugguga

SEQ ID NO: 13256 - RNA, 9879 nt, Artificial Sequence
  derived and/or modified CDS sequence (opt3) from DENV-1__GU131887__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacggaacgguccuugugcagauccgcuacgagggcacagacgcgccuugcaagauuccauucucgacccaagaugaaagagggguuacucagaacggaagguugaucacagcaaaucccauagugaccgacaaagagaagccuguaaacauugaagccgagccacccuuuggcgagucuuauaucgucaucggugcuggggaaaaagcccugaagcucuccugguucaaaaagggcucaaguauuggaaagauguuugaggcaacugcccggggcgcucgacgcauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucaagaaguacauccuucagcaugaccuguaucgcugugggccugguuacacuauaccucggggucauggugcaggccgauucuggaugcgugaucaacuggaaaggcagggaacugaagugugguucagggauuuuugucacuaaugagguucacaccuggacggaacaauauaaauuccaggcagacaguccgaagcggcuuagcgccgcuauaggaaaggccugggaggagggcgugugcgguauccgcuccgcaacaagauuggaaaacauuauguggaaacagaucucuaacgagcugaaucauauucuccuggaaaacgacaugaaguuuaccgugguagucggcgauguggcugggaucuuagcccagggcaagaagaugauaaggccucaacccauggaguacaaauauucguggcguagcuggggcaaggcgaaaaucauuggggccgacguucagaauacuaccuucaucauugauggaccaaacacaccugaaugucccgacgaucagcgggcuuggaauaucugggagguggaggacuacggcuuugguauauucacuaccaacauuuggcugaaacuucgagauuccuauacacaggucugcgaccacagauugaugucagcagccaucaaggauaguaaagcugugcacgccgacaugggguacuggauugaaucugagaagaaugaaacguggaaacucgcaagggcgagcuucaucgagguuaagaccuguauauggccaaaaucccauacucuguggucaaacggagugcuagaaagcgagaugaucauucccaagaucuauggcgguccuauuucucaacacaauuaccgcccaggcuacuuuacacagaccgccgggccguggcaucugggaaagcucgagcuggauuucgaccuuugcgaaggcacuacaguagucguggaugagcacugcgggaaccggggacccuccuugagaaccacgacugugaccggcaaaaucauacacgaaugguguugcaggaguuguacacugccuccauuacgcuuucgaggugaggacgggugcugguauggaauggagauucggcccgucaaggaaaaagaggaaaaucucguuaagagcauggugucugcuggcuccggugagguagacucauucagucugggccuucuguguaucagcaucaugauugaagaggugaugcguucgagaugguccaggaaaauguugaugaccgggacucucgccgucuuucugcuacugaucaugggacagcucacauggaacgaucugauucgccuuugcauaauggugggcgcaaaugcuucugaccggauggggaugggaaccacauacuuggcccugauggcaacuuucaagaugagaccuauguuugccguuggcuuacucuucaggcgacugaccagccgcgaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaaaaucuggggacggagaagcuggccauugaacgaagguauuauggccguaggcaucgugucgauucuccugucaucucuacugaagaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacaaugaaaaucaaggaugaggagagggacgauacccucacuauucugcuuaaagcuacacuguuggcagugaguggcgucuauccccuaagcauaccagccacccuguucguuugguacuucuggcaaaagaaaaagcagcguucuggcgugcucugggacacgccuucacccccagaaguggagcgcgcgguccuggaugacgggaucuaucggauuaugcagagaggacuuuuagguaggagccaggugggcguugggguauuucaagaaaacguguuccauacuauguggcacgucacccgaggagcugugcugauguaccagggcaaacggcucgagccgaguugggccagcguuaagaaggacuugaucuccuacggugggggauggcgccugcagggcucuuggaauacaggcgaggaagugcaggucauugcaguggagccugggaaaaaccccaagaauguacaaaccgccccaggaacauuuaaaacucccgaaggugaggucggcgcuaucgcccucgauuucaagccugggaccucgggaagcccaauagugaacagagaaggcaaaaucguuggucuguaugggaauggaguggucacgacaucaggcacuuacguguccgcaauugcucaggccaaggcgagucaggagggcccccuuccugagaucgaagacgagguuuuuaggaagcggaaccugaccauuauggauuugcacccggggucuggaaaaacacgaagauaucuaccagccaucgugcgcgaagcaauaaagaggaaacugcguacccucauuuuagcucccacucgggucguggccagcgagauggcugaagcacugaaggguaugccuaucagauaccaaaccacagccguaaaauccgagcauacgggcaaggagaucguggaccuuaugugccacgccacuuucaccaugaggcugcucucaccaguucgcguccccaauuauaacaugauuaucauggaugaagcucauuuuacagacccuucuagcauagcggcacgaggguacauuaguaccagagugggaaugggcgaggccgcugccaucuucaugacugcaacaccgcccgguuccguggaagccuuuccacagagcaaugcugucauucaggaugaggaacgggacaucccugagaggucuuggaacucaggguaugaguggauaaccgauuuccccggaaagacgguaugguuugugccauccauuaaaaguggcaaugacaucgcgaacuguuugcgcaagaauggcaaacguguuauccagcugagcagaaagacuuucgauacagaauaccagaagaccaagaacaacgacugggacuacguggucaccacugauauuucggagaugggggccaauuuccgggcagacagggugaucgauccucgccgaugccucaagcccguuauucugaaagacggaccagaaagagugauacuugcugguccgaugccugucacaguggccucugcagcccagcggaggggccgcaucgggagaaaccacaauaaggagggagaucaguauauuuacaugggccagccccuaaacaaugacgaggaucaugcucacuggaccgaagccaaaaugcuguuggacaacaucaauacaccagaggguaucauucccgcguuauuugaaccugagagggaaaaguccgcagccauagauggggaguaucggcugcguggcgaggcucgcaaaacuuucguagaacucaugcgaagaggagaccugccaguguggcuuagcuacaagguugccucagagggcuuucaauauagugauaggcgguggugcuucgacggggaacgcaacaaucagguccuggaggaaaacauggauguggagaucuggacgaaggagggagaaaggaagaagcucaggccccggugguuggacgcucgaaccuacucugacccucuggcacuaagagaguuuaaagaguucgccgcuggucgcagguccgugagcggcgaucugauucucgagaucgggaaacuuccgcagcaccugacacagcgggcccaaaaugcauuagacaacuuggucaugcugcauaauucagaacagggaggccgugcguauagacacgccauggaggagcucccagauacuauugaaacccugaugcuucuggcucucaucgccgcauugacaggugggguuacccuguuuuucuuaaguggcaggggacuaggcaaaacuagcauagggcugcucugugugauggcuuccucuguacuucuguggauggccagcguggagccccauuggaucgcagccuccauuaucuuggaauuuuuccugaugguccuccugauuccugagcccgaccgccagcggacgccacaggauaaccaacuugcuuacgugguuaucggacuccuguuuaugauauugaccguggcggccaaugagaugggucuguuagaaacaacuaagaaagaccuaggcauugggcacgucgcaguaggaaaccaccaucacgcugccaugcuggauguggaccuccauccugccucagcauggacccuuuacgcuguugccacaaccaucauuacucccaugaugcgacacacaaucgagaacacgaccgcgaauauaucucugacugcuaucgccaaccaggcagccauuuugaugggccuggauaaggguuggccaaucaguaagauggacauuggggugccucuccuggcucuuggcugcuauucgcaggucaauccguuaacacugaccgcagccgugcucauguuggucgcgcauuacgcuaucauaggacccggccugcaagccaaagcaaccagagaagcccagaagaggacagcugccgggauuaugaaaaacccaacuguggauggaaucguugcaaucgaccuagauccugugguauaugacgcuaaguucgagaaacagcugggccagauuaugcuccuuauccuguguacgagccaaauauugcugaugcgcaccacaugggcccucugcgaauccauuacucuggcgaccggucccuuaacaacccuuugggaggggucuccaggaaaguuuuggaauacuacgaucgccgugucaauggcaaacauuuuccggggcagcuaccuggcuggugccggccucgcauucucccuaaugaagagucuagggggaggcagacgugggacaggagcucagggcgagaccuugggugaaaaauggaagaggcagcugaaucagcucucuaaaagcgaguuuaacacuuauaagcggucagggaucauggaagucgaccgcuccgaggccaaagaaggacuuaagcgaggcgagauaaccaagcacgccguuaguagagguacagcgaaacugaggugguucguggagcggaauuuggucaagccugaaggcaaagugaucgaucugggguguggacgcggcggguggagcuacuauugcgcuggacucaagaaaguaacugaggugaagggcuacaccaagggugggcccggacacgaggaaccgauuccaauggcaacauacggcuggaacuuaguuaaacugcauucuggcaaggacguguuuuucgucccucccgaaaaaugugauacgcuucugugcgacaucggggaguccucaccaaaucccaccauugaggaaggaagaacucuaagggugcucaagauggucgagccuuggcugcgagguaaccaauuuuguaucaaaauuuugaauccguauaugcccagcgugguugaaacacuggagcagaugcagcggaagcacggcgggaugcucguacguaacccacuuucgagaaauucuacccaugagauguacugggugaguugcggaacuggcaacaucgucuccgccgugaauaugacaagccgcaugcuguuaaacagguucaccauggcucaccggaaaccuacguaugaaagagauguugaccugggugccgggacccgccacguggcagucgagcccgaaguggccaacuuggauauaauuggacagaggaucgagaauaucaagcaugaacacaagucaacauggcauuacgacgaggauaacccuuauaaaacuugggcuuaccacggcuccuaugagguaaagccaucuggcagcgcgaguuccauggugaaugggguugucaaacuccugaccaagcccugggacgugauuccuauggugacacaaauagccaugacugauaccacaccauuuggacagcagcgagucuucaaagaaaagguugacacccggacucccaaggcaaaaagagguacggcucaaaucauggaggugacagccaaguggcuauggggcuuucuuagcaggaacaaaaagccgcgcauuuguacccgugaagaguucacucggaaaguaagaucuaaugcagccaucggggcuguguuugucgacgaaaaccaguggaacucagccaaggaggcgguggaggaugaaagguucugggaccugguucaucgcgagcgagaacuccacaagcagggaaaaugcgcaaccugcguguacaacaugaugggcaagcgggagaaaaagcugggugaauuugggaaagccaagggaaguagagcuauuugguacaugugguugggcgccagguuccuggaguucgaggcacucggcuuuaugaaugaagaucacugguucucccgcgagaacagccuuucuggggucgaaggagagggucugcauaaguuaggcuauauccugagagacauaucgaaaaucccugggggaaauauguacgcugaugacacagccggcugggauacgcggauuaccgaggacgauuugcagaacgaagcuaggaucacugacauuauggagccagaacacgcccuccuggcaaagucaaucuuuaaacuaacauaucaaaauaaggugguacguguucagcgacccgcgaaaaacgguaccgugauggaugucauaagccgcagagaccagcggggguccggacaggugggcacuuacggccuuaauacauucaccaacauggaggcccaacugauuaggcagauggaaagugaggggaucuuuucuccuagcgagcucgaaacaccaaaccuggcugagcgcguguuggauugguuagaaaaguauggagucgagagacugaaacggauggccaucuccggugacgacuguguugugaagcccauugaugacagguucgcaacugcucucaccgcccuuaaugauaugggcaagguacgaaaagacauaccgcagugggaaccuucaaagggguggaacgauuggcagcaagugcccuuuugcagucaucacuuccaccagcugaucaugaaagacggacgugagauugucgugccauguagaaaucaggaugagcuaguuggccgcgcacgggugucucagggugccggguggagccugagggaaacggcgugccucggaaaguccuacgcucaaauguggcaguugauguauuuucauagacgcgaccugcggcuugccgcaaacgccaucuguucagcugucccuguggauuggauucccaccagcaggacaacuuggucuauccacgcccaucaccaguggaugaccacagaggacaugcuguccguauggaaucgaguuuggauagaagagaacccauggauggaagauaaaacucauaucaguagcuggggcgacgugcccuaccucggcaagagagaggaccaauggugcgggucguuaauuggacugaccgcacgggcuacgugggccacaaauauccaggucgcgauuaaccaggugaggcgcuugaucgguaaugagaacuaccuggauuauaugaccuccaugaagcguuucaaaaaugaaucugacccugagggcgcucucugguga

SEQ ID NO: 13257 - RNA, 9879 nt, Artificial Sequence
  derived and/or modified CDS sequence (opt3) from DENV-1__GU131888__SS-prME
agcgugaccaugcugcucaugcuuaugccaacagcacuggcuuuccacuugacuacgagaggaggggagccucauaugaucgucuccaagcaagaaagaggaaaaucuuuacuguuuaagaccucagccgguguuaauaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagucggccuggaaacagauccagaggguggaaacuugggcucuccggcacccuggguucaccguuauugcacuguuucuggcccaugcuaucggaacaucaauuacccagaagggcaucauauucauccucuuaaugcuggugacgccaagcauggccaugcgcugcgucggcauugggaguagagauuuuguggagggacuuuccggugcgacuuggguagacguuguguuggagcacggcucuugugucacaaccauggcaaaggauaaacccacucuggacaucgaacuacucaagacagaggugaccaacccugccauucugaggaaacuuugcaucgaagcuaagauaagcaauacgaccacagauucccgguguccaacucaaggggaggccacccugguggaagaacaggacgcaaacuucgucugccgccgaacauuuguugauagaggauggggcaaugguuguggguuguucggaaaaggcucacucauuacuugcgcuaaguuuaagugcgugaccaaacuggagggcaagaucguacaguacgaaaacuuaaaauauagugugauugucacagugcacaccggggaccagcaucaaguuggaaaugagagcacugaacacgguacgacagccaccaucacuccccaggcgccuaccacagagauccagcugaccgacuacggcgcccucacucuugauuguucuccaaggacagggcuggacuucaacgaaaugguguugcuaacgaugaaggagaaauccuggcugguccauaagcagugguuucucgaucugccgcuucccuggaccucaggagcaagcacaagucaagagacauggaaucggcaggaccuguuggugaccuucaaaacagcucacgccaagaagcaggaaguaguugugcucggcucucaagagggugcuaugcacacugcccugaccggggcaacggaaauucagaccuccggcacaacuaccauauuugccggacauuuaaaaugccgucugaagauggauaaacuaacacucaagggcaugagcuaugucauguguacugggucguucaaacuggagaaggaaguggcugagacccagcacggaacgguccuugugcagaucaaguacgaggguacagacgcgccuugcaaaauuccauucuugacccaagaugaaaagggcguuacucagaacgggcgccugaucacagcaaaucccauagugaccgacaaagagaagccuguaaacauugaagccgagccacccuuuggagagucuuauaucgucaucggcgcuggugaaaaagcccucaagcuguccugguucaagaaagggucaaguauuggcaagauguuugaggcaacugccagaggagcuaggcggauggccauccuuggcgauaccgggugggacuucggaagcauugguggcguguuuacauccguugggaaacuggugcaucagauauucggaacggcauacggcgucuuguuuucuggugugagcuggaccaugaagaucgggauuggcguacuccugacuugguuaggacuaaauucacgaaguacaucccuaagcaugaccuguaucgcggugggccucguuacacuguaccuuggggucauggugcaggcugauucuggaugcgugaucaacuggaaaggccgcgaauugaagugugguucagggauuuucgucacuaaugagguucacaccuggacggaacaauauaaguuucaggccgacaguccgaaaagacugagcgcagccauaggaaaggcuugggaggagggcgugugcgguaucagguccgccacacggcucgaaaacauuauguggaaacagaucucuaacgagcugaaucauauuuuacuggaaaacgacaugaaguucaccgugguagucggcgauguggcagggauccuugcucagggcaagaagaugauacgcccucaacccauggaguacaaauauucguggaaaagcuggggcaaggccaaaaucauuggggcggacguucagaauacuaccuuuaucauugauggaccaaacacaccugaaugucccgacgaucagagagccuggaauaucugggagguggaggacuacggcuucgguauauuuacuaccaacauuugguugaagcucagggauuccuauacacaggucugcgaccaccgucugaugucagcugcaaucaaagauaguaaggccgugcacgcugacaugggguacuggauugaaucugagaaaaaugaaacguggaagcuagcccgggccagcuucaucgagguuaagaccuguauauggccaaaaucccauacucuguggucaaacggagugcucgaaagcgagaugaucauucccaagaucuauggcgguccuauuucucaacacaauuaccgaccaggcuacuucacacagaccgcggggccguggcaucugggaaaacuugaguuggauuuugaccugugcgaaggcacuacaguagucguggaugagcacugcgggaacagaggacccuccuuaaggaccacgacugugaccggcaagaucauacacgaaugguguugccgcaguuguacacucccuccacugcgguucagaggugaggacgggugcugguauggaauggagauuaggcccgucaaagaaaaggaggaaaaucuuguuaagagcauggugucugccggcuccggugagguagacucauuuagucugggcuugcucuguaucagcaucaugauugaagaggugaugcgcucgcgauggucccggaaaaugcugaugaccgggacucuagcugucuuccugcuccugaucaugggacagcuuacauggaacgauuugauucgucugugcauaauggugggcgccaaugcaucugacagaauggggaugggaaccacauacuuagcucucauggccacuuuuaagaugaggccuauguucgcaguuggccugcuuuuucgccggcugaccagcagagaggugcuacuccugacgaucgguuugucacuggucgccaguguggaauuaccaaacucccucgaggaacugggggauggacuugcuaugggcauuaugauccugaaauugcucacagacuuccaaucucaucagcugugggcgacccuacugagccuuacuuuuauuaagaccacauucucccuccacuaugccuggaaaacuauggcaaugguucugucaaucgugagcuuguuuccccuguguuuaaguaccacgucucagaagacaaccuggcucccgguccugcuuggcucccuggggugcaagccuuugacuauguuccucauagcugagaauaaaaucuggggaaggcgaagcuggccacugaacgaagguauuauggccguaggcaucgugucgauucuacugucaucucuucucaagaacgauguuccccuggccgggccuuugaucgcuggaggcauguuaauagcauguuacgugauuagugguuccagcgccgaccugucucucgagaaagcggcugaggucagcugggaagaggaagccgagcauuccggggcaucacacaauauccugguggaaguacaggaugacggacccaugaagaucaaagaugaggagcgcgacgauacacuuaccauucuguugaaggccacucuacuggcugugaguggcgucuauccacucagcauaccugcaacacuguuuguuugguacuucuggcagaaaaagaagcagcggucuggcgugcuuugggacacccccuccccaccggaaguggagagagccgucuuagaugacgggaucuauaggauuaugcagcguggacugcucggucgcucacaggugggcguugggguauuccaagaaaacguguuucauacgauguggcacgucacucggggagcgguguugauguaccagggcaaaagacuggagccuaguugggcuagcguuaagaaagaccucaucuccuacggugggggauggaggcugcagggcucuuggaauaccggcgaggaagugcaggucauugccguggagcccgggaagaaccccaaaaauguacaaacagcacccggaaccuucaagacaccugaaggugaggucggcgccaucgcucuugauuuuaagccagggacuucgggaagccccauagugaaccgagaaggcaaaaucguuggucuguaugggaauggaguggucaccacgucaggcacauacguguccgccauugcacaggcuaaggccagucaggagggcccuuugccggagaucgaagacgagguuuuccggaaacgcaaccuaacuauuauggaucugcacccagggucuggaaagaccagaagguaucuccccgcgaucgugcgggaagccauaaaacgaaaguuaagaacacugauucuugcaccuacccgcgucguggcuagcgagauggccgaagcucugaaggguaugccaaucagguaccaaacuaccgcaguaaaauccgagcauacaggcaaggagaucguggaccucaugugccacgccacguuuacuaugcguuugcugucacccguucgggucccuaauuauaacaugauuaucauggaugaagcccauuucaccgacccgucuagcauagcugcgagaggguacauuaguacaagggugggaaugggcgaggcagccgcuaucuuuaugaccgccacucccccagguuccguggaagcauucccucagagcaaugcccucauucaggaugaggaacgcgacauccccgagcgaucuuggaacucaggguaugaguggauaacagauuuuccaggaaaaaccgucugguucguaccuuccauuaagaguggcaaugacaucgcuaacugucugaggaaaaauggcaagcgggugauccagcuuagcaggaagacguuugauacugaauaccaaaagacuaagaacaacgacugggacuacguugugaccaccgauauuucggagaugggggcgaauuuccgcgccgaccgugucaucgaucccagacggugccuaaaaccagugauucugaaggacggaccggaaaggguuauauuggcagguccuaugcccgugacugucgcuucugccgcacagcgccgaggcagaaucgggcggaaccacaauaaagagggagaucaguauauuuacaugggccagccauuaaacaaugacgaggaucaugcccacuggacagaagcuaagaugcugcucgacaacaucaauacccccgaggguaucauuccugcccuguucgaaccagagagggaaaaguccgcggcaauagauggggaguaucgccuuagaggcgaggccaggaaaacauuuguggaacugaugcggcguggagaccuccccguaugguugagcuacaagguggcuucagagggcuuccaauauagugaucgccgauggugcuuugacggggaaagaaacaaucagguucuggaggaaaacauggaugucgagaucuggacuaaagagggagaaaggaagaaacuacggccucgcuggcuggacgccagaacguacucugacccgcucgcucuuagggaguucaaggaauuugcagccggucggcgauccgugagcggcgaucugauuuuagagaucgggaaauugccacagcaccugacccagagagcucaaaaugcccucgacaaccuggugaugcuucauaauucagaacagggaggccgcgcauauaggcacgcgauggaggagcugcccgauacaauugaaacucucauguugcuggccuuaaucgcuguccuaaccggugggguuacacuguucuuucucaguggccggggacuuggcaagaccagcauagggcuguugugugugauggccuccucuguacugcucuggauggcaagcguggagccucauuggaucgcugccuccauuauccuggaguucuuucuuaugguccuccugauucccgagccagaccgucagagaacuccucaggauaaccaauuggcauacgugguuaucggacuguuauucaugauacuaacgguggccgcuaaugagaugggucugcucgaaaccacaaagaaagaccuuggcauugggcacgucgcgguaggaaaccaccaucacgccgcaaugcuggauguggacuugcaucccgcuucagccuggacucuguacgccguugcaaccacaaucauuaccccaaugaugaggcacacuaucgagaacacaacggcuaauauaucucucaccgccaucgcgaaccaggcugccauucugaugggccuugauaaggguuggccuaucaguaaaauggacauuggggugccguuacuggcacucggcugcuauucgcaggucaaucccuugacucugacagccgcugugcuaaugcuggucgcacauuacgccaucauaggaccaggccuccaagcgaaggcuacccgcgaagcccagaaacggaccgcagccgggauuaugaagaacccuacaguggauggaaucguugcuaucgaccuugaucccgugguauaugacgccaaguuugagaaacagcugggccagauuauguugcugauccucuguacuagccaaauacuguuaaugcgaacgaccugggcacuuugcgaauccauuacacuggcuacugguccacucaccacacuaugggaggggucuccuggaaaguucuggaauaccacuaucgccgugucaauggcgaacauuuuuagaggcagcuaccuggccggugcaggcuuggcuuucucccugaugaaaagucucgggggaggcaggcgcgggacgggagcccagggcgagacacuuggugaaaaguggaaacggcagcugaaucaguugucuaagagcgaguucaacaccuauaagagaucagggaucauggaagucgaccguuccgaggcaaaagaaggacugaagaggggcgagacuaccaaacacgcuguuagucgggguacagccaagcuccgcugguuuguggagcgaaauuuagucaaacccgaaggcaaggugauagaucugggguguggaagaggcggguggagcuacuauugcgccggacuuaagaaaguaacugaggugaagggcuacaccaaaggugggccgggacacgaagaaccaaucccuauggcgacauacggcuggaaccugguuaagcuacauucuggcaaagacguguucuuuauucccccagaaaagugugauacgcuccugugcgacaucggggaguccucacccaauccuaccauugaggaaggaaggacuuugcggguccugaaaaugguggagccguggcuccgcgguaaccaauucuguaucaagauucuuaaucccuauaugccaagcgucguggaaacacuggagcagaugcagagaaagcacggcgggauguuaguuaggaacccucugucgcgaaauucuacccaugagauguacuggguaaguugcggaacuggcaacaucguguccgcugucaauaugacaagccggauguugcucaaccguuuuaccauggcacacagaaaacccacguaugaacgcgauguggaccugggugccgggaccaggcacguugcuguggagccugaagucgccaaccuagauauaauuggacagcggaucgagaauaucaagcaugaacacaaaucaacauggcauuacgacgaggauaacccauauaagacuugggcauaccacggcuccuaugaggugaaacccucuggcagcgccaguuccaugguaaauggggugguuaaacuucugaccaagccuugggacgucauuccaauggugacacaaauagcuaugacugauaccacacccuucggacagcagagaguguuuaaagaaaaggucgacacccgcacuccgaaagcgaagagggguacggcccaaaucauggagguuacagcaaaauggcucuggggcuuccugagccgaaacaagaagccucggauuuguaccagagaagaguuuacuaggaaagugcgcucuaaugcugccaucggggcaguauucguggacgaaaaccaguggaacucagccaaggaggcugucgaggaugaacguuuuugggacuuggugcaucgggagagagaacugcacaaacagggaaagugcgcaaccugcguuuacaacaugaugggcaaaagggagaagaagcucggugaguucgggaaagcgaagggaagucgcgcaauuugguacauguggcuuggcgcccgauuucuggaguucgaggcuuuaggcuucaugaaugaagaucacugguuuucccgggagaacagccugucugggguggaaggagaggguuugcauaaacucggcuauauccugagagacauaucgaagaucccagggggaaauauguacgccgaugacacagcaggcugggauacgaggauuaccgaggacgaucuacagaacgaagcucgcaucacugacauuauggagcccgaacacgcccuucuggcuaaaucaaucuucaagcucacauaucaaaauaaagucgugagaguacagcggccugccaagaacgguaccguuauggaugugauaagcaggcgugaccagcgaggguccggacaggucggcacuuacggccugaauacauuuaccaacauggaggcacaauugauucgccagauggaaagugaggggaucuucucuccaagcgaguuagaaacacccaaccuggcggagagagugcucgauuggcuugaaaaguauggaguggagcggcugaaaaggauggccaucuccggugacgacugugucguuaagccgauugaugaccgcuuugcuacugcccuaaccgcacugaaugauaugggcaaagugagaaaggacauaccucagugggaacccucaaaaggguggaacgauuggcagcaaguaccauucugcagucaucacuuucaccagcucaucaugaaggacggacgggagauuguggucccuuguaggaaucaggaugaguuggugggccgagcucguguuucucagggugccggguggagccugagagaaacggcaugccuuggaaaguccuacgcccaaauguggcagcugauguauuuccaucgccgggaccucagguuagcggcuaacgccaucuguucagcagugcccgucgauuggauuccaaccagcagaacaacuuggucuauccacgcccaucaccaguggaugaccacagaggacaugcuguccguguggaaucgcguauggauagaagagaaccccuggauggaagauaaaacucauaucaguagcuggggcgacguuccuuacuugggcaagcgggaggaccaauggugcgggucgcugauuggacucaccgcuagggccacgugggcaacaaauauccagguggcuauuaaccagguccgaagacuuaucgguaaugagaacuaccuggauuauaugaccuccaugaaacgguuuaagaaugaaucugacccagagggcgcccuaugguga

SEQ ID NO: 13258 - RNA, 9879 nt, Artificial Sequence
  derived and/or modified CDS sequence (opt3) from DENV-1__GU131892__SS-prME
agcgugaccaugcugcucaugcuuaugcccacagcacuggcuuuccacuugacuacgagaggaggggagccucauaugaucgucuccaagcaagaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacggaacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccugguucagggcaagaagaugauacgcccucaacccauggaguacaaauauucguggaaaagcuggggcaaggccaagaucauuggggcggacgugcagaauacuaccuuuaucauugauggaccaaacacaccugaaugucccgacgaucagagagccuggaauaucugggaggucgaggacuacggcuucgguauauuuacuaccaacauuuggcuuaaguugagggauuccuauacacaggugugcgaccaccgucucaugucagcugcaaucaaagauaguaaggccguucacgcugacaugggguacuggauugaaucugagaaaaaugaaacguggaagcuggcccgggcauccuucaucgaggugaagaccuguauauggccaaaaucccauacucuauggucaaacggaguacuggaaagcgagaugaucauucccaagaucuauggcgguccuauuucucaacacaauuaccgaccaggcuacuucacacagaccgcggggccguggcaucucggaaaacuggagcuugauuuugacuugugcgaaggcacuacagucgugguggaugagcacugcgggaacagaggacccucccugaggaccacgacugucaccggcaagaucauacacgaaugguguugccgcaguuguacauuaccuccacuccgguucagaggugaggacgggugcugguauggaauggagauuaggcccguuaaagaaaaggaggaaaaucugguaaagagcaugguaucugccggcuccggugagguggacucauuuagucuuggccuguuguguaucagcaucaugauugaagaggucaugcgcucgcgauggucccggaaaaugcucaugaccgggacucuggcuguguuccuacugcucaucaugggacagcugacauggaacgaucuuauucguuugugcauaaugguuggcgccaaugcaucugacagaauggggaugggaaccacauaccuggcuuuaauggccacuuuuaagaugaggccuauguucgcagugggccuccuguuucgccggcuuaccagcagagagguccugcuacucacgaucggucugucauugguggccaguguugaacugccaaacuccuuagaggaacucggggauggacuggcuaugggcauuaugauccuuaaacuguugacagacuuccaaucucaucagcucugggcgacccugcuaagccugacuuuuauuaagaccacauucucccuucacuaugccuggaaaacuauggcaauggugcucucaaucgucagccuguuucccuugugucugaguaccacgucucagaagacaaccugguuaccgguacuccugggcucccuugggugcaagccucugacuauguucuugauagcugagaauaaaaucuggggaaggcgaagcuggccacucaacgaagguauuauggccgugggcaucguuucgauucugcuaucaucucugcuuaagaacgaugugccccucgccgggccucugaucgcuggaggcauguugauagcauguuacgucauuagugguuccagcgccgacuuaucucuggagaaagcggcugaggugagcugggaagaggaagccgagcauuccggggcaucacacaauauccucguagaagugcaggaugacggaacaaugaagaucaaagaugaggagcgcgacgauacccugacuauucuucugaaggccacauugcuagcugucaguggcguuuauccccugagcauaccagcaacccucuuugugugguacuucuggcagaagaagaagcagcggucuggcgugcugugggacacgccuucacccccagaagucgagagagccgugcuugaugacgggaucuauaggauuaugcagcguggauuacugggucgcagccagguuggcguagggguguuccaagaaaacgucuuucauacuauguggcacgugacccggggagcgguucucauguaccagggcaaaagauuggagccgaguugggcuagcgugaagaaagaccugaucuccuacggugggggauggaggcuccagggcucuuggaauacaggcgaggaaguccaggugauugccguagagccugggaagaaccccaaaaauguccaaaccgcaccaggaacauucaagacucccgaaggugaggugggcgccaucgcucuggauuuuaagccugggaccucgggaagcccaauaguuaaccgagaaggcaaaaucgugggucuuuaugggaauggagucgugacgacaucaggcacuuacguuuccgccauugcacaggcuaaggccagucaggagggcccccugccugagaucgaagacgagguguuccggaaacgcaacuugaccauuauggaucuacacccggggucuggaaagacaagaagguaucugccagcgaucguccgggaagccauaaaacgaaagcucagaaccuuaauucuggcacccacucgcgugguagcuagcgagauggccgaagcucuuaaggguaugccuaucagguaccaaaccacagcagugaaauccgagcauacgggcaaggagaucguugaccugaugugccacgccacuuuuaccaugcgucucuugucaccaguccgggugcccaauuauaacaugauuaucauggaugaagcccauuucacagacccuucuagcauagcugcgagaggguacauuaguaccagggugggaaugggcgaggcagccgcuaucuuuaugacugccacaccgcccgguuccgucgaagcauucccacagagcaaugccguaauucaggaugaggaacgcgacaucccugagcgaucuuggaacucaggguaugaguggauaaccgauuuucccggaaaaacggugugguucguuccauccauuaagaguggcaaugacaucgcuaacugucugaggaaaaauggcaagcgggugauccagcucagcaggaagacuuuugauacagaauaccagaaaaccaagaacaacgacugggacuacgucgugaccacugauauuucggagaugggggcgaauuuccgcgccgaccguguuaucgauccuagacggugccugaaacccgugauucuuaaggacggaccagaaagggucauacuagcagguccgaugccugugacaguagcuucugccgcacagcgccgaggcagaaucgggcggaaccacaauaaagagggagaucaguauauuuacaugggccagccccugaacaaugacgaggaucaugcccacuggaccgaagcuaagauguuguuagacaacaucaauacaccagaggguaucauucccgcccuguucgaaccugagagggaaaaguccgcggcaauagauggggaguaucgccucagaggcgaggccaggaaaacuuuuguggaacugaugcggcguggagaccuuccaguuuggcugagcuacaaggucgcuucagagggcuuccaauauagugaucgccgauggugcuuugacggggaaagaaacaaucaggugcucgaggaaaacauggauguggagaucuggacgaaagagggagaaaggaagaaauugcggccccgcuggcuggacgccagaaccuacucugacccucuagcucugagggaguucaaggaauuugcagccggucggcgauccgucagcggcgaucucauucuugagaucgggaaacugccgcagcacuuaacacagagagcucaaaaugccuuggacaaccugguuaugcuccauaauucagaacagggaggccgcgcauauaggcacgcgauggaggagcugccagauacuauugaaacccuuaugcugcucgccuugaucgcugugcugacaggugggguaaccuuauucuuucuaaguggccggggacugggcaagacuagcauagggcuccuuugugugauggccuccucuguccuguuguggauggcaagcguggagccccauuggaucgcugccuccauuauccuggaguucuuucucaugguucugcuuauuccugagcccgaccgucagagaacgccacaggauaaccaacucgcauacguggucaucggacuguuguucaugauacugaccguagccgcuaaugagauggguuuacuagaaacaacuaagaaagaccugggcauugggcacguggcgguuggaaaccaccaucacgccgcaaugcucgauguggaccuucauccugcuucagccuggacccuguacgccgucgcaacaaccaucauuacucccaugaugaggcacacaaucgagaacacgaccgcuaauauaucuuugacugccaucgcgaaccaggcugccauucugaugggccucgauaaggguuggccaaucaguaaaauggacauuggggugccucugcuugcauuaggcugcuauucgcaggucaauccgcugacacucaccgccgcuguguugaugcugguugcacauuacgccaucauaggacccggccuacaagcgaaggcuacccgcgaagcccagaaacggacagcagccgggauuaugaagaacccaacuguggauggaaucguagcuaucgaccuggauccuguggucuaugacgccaaguuugagaaacagcucggccagauuaugcuucugaucuuguguacgagccaaauacugcucaugcgaaccacaugggcacugugcgaauccauuacuuuagcuaccgguccccuuacaacccugugggaggggucuccaggaaaguucuggaauacuacgaucgccguuucaauggcgaacauuuuuagaggcagcuaccucgccggugcaggccuagcuuucucccugaugaaaagucuagggggaggcaggcgcgggacaggagcccagggcgagacccugggugaaaaguggaaacggcagcucaaucagcuuucuaagagcgaguucaacacuuauaagagaucagggaucauggaaguggaccguuccgaggcaaaagaaggacugaagaggggcgagaccacaaaacacgcugucagucgggguacugccaaguugcgcugguuuguggagcgaaaucugguaaaaccugaaggcaaggugauagaucucggguguggaagaggcggguggagcuacuauugcgccggauuaaagaaaguuaccgaggugaagggcuacacaaaaggugggcccggacacgaagaaccgaucccaauggcgacguacggcuggaaccuggucaaacuucauucuggcaaagacguguucuuuauuccucccgaaaagugugauacccugcuaugcgacaucggggaguccucaccaaaucccacuauugaggaaggaaggacacuccggguccugaaaaugguggagccuugguugcgcgguaaccaauucuguaucaagauucugaauccguauaugcccagcguuguagaaacccucgagcagaugcagagaaagcacggcgggaugcuugugaggaacccacugucgcgaaauucuacucaugagauguacugggucaguugcggaacaggcaacaucguguccgcuguuaauaugaccagccggauguuacugaaccguuuuacgauggcacacagaaaaccuaccuaugaacgcgauguggacuugggugccgggacaaggcacgucgcuguggagcccgaaguagccaaccucgauauaauuggacagcggaucgagaauaucaagcaugaacacaaaucaacuuggcauuacgacgaggauaacccuuauaagaccugggcauaccacggcuccuaugaggugaaaccaucuggcagcgccaguuccaugguuaauggggucgugaagcugcuaacaaagcccugggacgugauuccuauggucacucaaauagcuaugaccgauacaaccccauucggacagcagagaguuuuuaaagaaaagguggacacucgcacgcccaaagcgaagagggguacagcccaaaucauggagguaaccgcaaaauggcuuuggggcuuccugagccgaaacaagaagccgcggauuuguacuagagaagaguuuaccaggaaagugcgcucuaaugcugccaucggggcagucuucguggacgaaaaccaguggaacucagccaaggaggcuguugaggaugaacguuuuugggaccucgugcaucgggagagagaacugcacaaacagggaaagugcgccacaugcgucuacaacaugaugggcaaaagggagaagaaguugggugaguucgggaaagcgaagggaagucgcgcaauuugguacauguggcugggcgcccgauuucucgaguucgaggcucuuggcuucaugaaugaagaucacugguuuucccgggagaacagccugucugggguggaaggagaggguuuacauaaacugggcuauaucuugagagacauaucgaagaucccugggggaaauauguacgccgaugacacggcaggcugggauaccaggauuacugaggacgaucuccagaacgaagcucgcaucacagacauuauggagccagaacacgcccugcuagcuaaaucaaucuucaaacuuaccuaucaaaauaaaguaguuagagugcagcggcccgccaagaacgguacugucauggaugugauaagcaggcgugaccagcgaggguccggacaggugggcacauacggccugaauaccuuuacaaacauggaggcacaacucauucgccagauggaaagugaggggaucuucucuccuagcgagcuggaaacuccaaacuuggcggagagagucuuagauuggcuggaaaaguauggaguugagcggcucaaaaggauggccaucuccggugacgacugugugguaaagcccauugaugaccgcuuugcuaccgcccuuacggcacugaaugauaugggcaaagugagaaaggacauaccgcagugggaaccuucaaaaggguggaacgauuggcagcaaguccccuucugcagucaucacuuucaccagcuaaucaugaaggacggacgggagauugugguuccauguaggaaucaggaugagcuggugggccgagcucgugucucucagggugccggguggagccucagagaaaccgcaugcuugggaaaguccuacgcccaaauguggcagcugauguauuuccaucgccgggaccuuaggcuggcggcuaacgccaucuguucagcagugccuguagauuggauucccacaagcagaacuaccuggucuauccacgcccaucaccaguggaugacaacugaggacaugcucuccguuuggaaucgcguguggauagaagagaacccauggauggaagauaaaacccauaucaguagcuggggcgacguccccuacuuaggcaagcgggaggaccaauggugcgggucgcugauuggauugacggcuagggccacaugggcaaccaauauccagguggcuauuaaccagguucgaagacugaucgguaaugagaacuaccucgauuauaugacuuccaugaaacgguuuaagaaugaaucugacccugagggcgcccuuugguga

SEQ ID NO: 13259 - RNA, 9879 nt, Artificial Sequence
  derived and/or modified CDS sequence (opt3) from DENV-1__GU131893__SS-prME
uccgugaccaugcugcucaugcuuaugcccacagcacuggcuuuccacuugacuacgagaggaggggagccucauaugaucgucuccaagcaagaaagaggaaaaucuuuacuguuuaagaccucagccgguguuaacaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacugcucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucaugacuugcgcuaaguuuaagugcgugaccaaacuggaggggaagauuguacaguacgaaaacuuaaaauauucagugaucgucacagugcacaccggagaccagcaucaaguugguaaugagaguacugaacacggcacgacagccaccauuacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaagggggcaacucagaacggacgcuugauuacagccaaucccaucguuaccgacaaagagaagccugugaacauagaagcugagccacccuuuggcgagucuuauauuguaaucggugccggggaaaaagcacugaagcucuccugguucaagaaaggcucaaguaucggaaagauguuugaggccacugcuagaggcgccaggcggauggcaauucugggggauaccgcgugggacuucggaagcaucgguggcgucuuuacauccguggggaaacuuguucaucagauuuucggaacggcuuacggcgugcuguuuucuggugucagcuggaccaugaagauaggguugggcgugcuccugacuugguuaggacuaaauucacgaaguacaucccuaagcaugaccuguaucgccguaggccucgugacacuguaccuugggguuaugguccaggcagauucuggaugcgugauuaacuggaaaggccgcgaauugaagugugguucagggaucuucgugacuaaugagguccacaccuggacggaacaauauaaguuucaggccgacaguccgaaaagacugagcgcugccaucggaaaggcaugggaggagggcguuugcgguauuagguccgcuacacggcucgaaaacauaauguggaaacagaucucuaacgagcugaaucauauuuuacuggaaaacgacaugaaguucaccguggugguaggcgaugucgccgggauccuugcgcagggcaaaaagaugauucgcccucaacccauggaguacaaauauucguggaaaagcuggggcaaggccaagaucauaggggcugacgugcagaauacuaccuuuaucauugauggaccaaacacaccugaaugucccgacgaucagagagcauggaauaucugggagguugaggacuacggcuucgguauuuuuacuaccaacaucugguugaagcucagggauucccacacacaggugugcgaccaccgucugaugucagccgcuauaaaagauaguaaggccguccaugcagacaugggguauuggauugaaucugagaaaaaugaaacguggaagcuagcgcgggccagcuucaucgaggugaagaccuguauuuggccaaaaucccacacucuguggucaaacggaguucucgaaagcgagaugaucauacccaagaucuacggcgguccuauuucucaacauaauuaucgaccaggcuacuucacacagaccgcugggccguggcaccugggaaaacuugaguuggauuuugaccugugcgaaggcacuacagugguagucgaugagcacugcgggaacagaggacccuccuuaaggaccacgacugugaccggcaagaucauucaugaaugguguugccgcaguuguacacucccuccacugcgguucagaggugaggacgggugcugguacggaauggagaucaggcccgugaaagaaaaggaggaaaaucuugucaagagcaugguuucugccggcuccggugagguggacucauuuagucugggcuugcucuguauaagcauuaugaucgaagagguaaugcgcucgcgauggucccggaaaaugcugaugaccgggacucuagcaguguuccugcuccugaucaugggacagcuuacauggaacgauuugauucgucugugcaucauggucggcgcuaaugccucugacagaauggggaugggaaccacauauuuagcacucauggccacuuuuaagaugaggccuauguucgcugugggccugcuuuuucgccggcugaccagcagagagguucuacuccugacgauugguuugucacugguggcgagugucgaauuaccaaacucccucgaggaacugggggauggacuugccaugggcauaaugauccugaaauugcucacagacuuccaaucucaccagcugugggcaacccuacugagccuuacuuuuauuaagaccacauucucccuccauuacgcuuggaaaacuauggccauggugcugucaaucguuagcuuguuuccccuguguuuaaguaccacgucucagaagacaaccuggcucccggugcugcuuggcucccuggggugcaagccuuugacuauguuccucauugccgagaauaaaaucuggggaaggcgaagcuggccacugaacgaagguauaauggcugucggcaucguaucgauucuacugucaucucuucucaagaacgaugugccccuggcagggccuuugaucgccggaggcauguuaauugcguguuauguuaucagugguuccagcgcugaccugucucucgagaaagccgcagaggugagcugggaagaggaagccgagcacuccggggcuucacauaauauacuggucgaagugcaggaugacggaacaaugaagauuaaagaugaggagcgcgacgauacccuuacuauccuguugaaggcaacacuacuggccguaaguggcguguacccccucagcaucccagcgacccuguuugucugguauuucuggcagaaaaagaagcagcggucuggcguucuuugggacacgccuucacccccagaaguggagagagcuguguuagaugacgggauuuacaggauaaugcagcguggacugcucggucgcagccaggucggcguggggguuuuccaagaaaacguauuucacacuauguggcacgugacccggggagccgucuugauguaucagggcaaaagacuggagccgaguugggcaagcgugaagaaagaccucaucuccuacggugggggauggaggcugcagggcucuuggaauacaggcgaggaaguucaggugauugccgucgagccugggaagaaccccaaaaaugugcaaaccgcuccaggaacauucaagacucccgaaggugagguaggcgccaucgcacuugauuuuaagccugggaccucgggaagcccaauugucaaccgagaaggcaaaaucgugggucuguacgggaauggaguugugacgacaucaggcacuuaugucuccgcuauagcccaggcgaaggccagucaggagggccccuugccugagaucgaagacgagguguuccggaaacgcaaccuaaccauuauggaucugcauccggggucuggaaagacaagaagguaccucccagcaaucguucgggaagcuauuaaacgaaaguuaagaacccugauccuugcccccacucgcguggucgcuagcgagauggcagaagcccugaaggguaugccuauaagguaucaaaccacagccgugaaauccgagcacacgggcaaggagauuguagaccucaugugccaugcuacuuuuaccaugcguuugcugucaccagugcggguucccaauuacaacaugaucaucauggaugaagcgcacuucacagacccuucuagcauugcagccagaggguauaucaguaccagggucggaaugggcgaggcugccgcaauauuuaugacugccacaccgcccgguuccguggaggcuuucccacagagcaaugcggugauucaggaugaggaacgcgacaucccugagcgaucuuggaacucaggguacgaguggauuaccgauuuucccggaaaaacggucugguucguaccauccaucaagaguggcaaugacauagccaacugucucaggaaaaauggcaagcgggugauucagcugagcaggaagacuuuugauacagaauaucagaaaaccaagaacaacgacugggacuacguugugaccacugauaucucggagaugggggcaaauuuccgcgcugaccgugucaucgauccuagacggugccuuaaacccgugauucuaaaggacggaccagaaaggguuauccuggccgguccgaugccugugacagucgcaucugccgcucagcgccgaggcagaauugggcggucccauaacaaagagggagaucaguacauauauaugggccagcccuugaauaacgacgaggaucacgcccacuggaccgaagcgaagauguuacuggacaauaucaacacaccagaggguauuauccccgcacucuucgaaccugagagggaaaagagcgccgcuaucgauggggaguaccgccugagaggcgaggccaggaaaacuuuuguggaacuuaugcggcguggagaccugccaguauggcucucauauaagguggcuagugagggcuuccaauacucugaucgccgauggugcuuugacggggaaagaaauaaccagguuuuggaggaaaauauggaugucgagauuuggacgaaagagggagaaaggaagaaacugcggccccgcuggcuagacgcaagaaccuauuccgacccucuggcccucagggaguucaaggaauuugcugccggucggcgaagcgugucaggcgaucuuauacuggagaucgggaaauuaccgcagcauuugacacagagagcacaaaacgcgcuggacaaucucgugaugcugcacaacagugaacagggaggccgcgccuacaggcaugcuauggaggagcuuccagauacuauugaaacccugaugcucuuggcccugaucgcagucuuaacaggugggguuacccuauucuuucugagcggccggggacucggcaagacuuccauugggcuucugugugugauggcuucuagcguauugcuguggauggccuccguggagccccacuggaucgcagccucaauaauccucgaguucuuucugaugguccuucucauuccugagcccgaccgucagagaacgccacaggauaaucaacuggcuuaugugguuaucggauugcuguucaugauuuuaaccguggcggccaacgagaugggucuacuggaaacaacuaagaaagaccucggcaucgggcacgucgcaguaggaaaucaucaccaugcugccaugcuugauguggaccugcacccugccucugcauggaccuuguacgcuguugccacaaccauaauuacucccaugaugaggcauacaaucgagaacacgaccgcgaacauuagucugacugcuaucgccaaucaggcagccauacucaugggccuggauaaggguuggccaaucucgaaaauggacauuggggugccucuuuuagcucugggcugcuacagccaggucaacccgcucacauugaccgcagccgugcugaugcuagucgcgcacuaugcuaucauuggacccggccugcaagccaaggcaacccgcgaagcccagaaacggacagcugccgggaucaugaagaauccaacuguggauggaauaguugcaauugaccucgauccugugguauacgacgcuaaguuugagaaacagcuuggccagaucaugcuguugauccuguguacgucccaaauucuccugaugcgaaccacaugggccuuaugcgaaucuaucacucuugcgaccgguccccugacaacccucugggaggggucaccaggaaaguucuggaacacuacgauagccgugagcauggcaaauauuuuuagaggcuccuaucuagcuggugccggccuggcauucaguuugaugaaaucucuagggggaggcaggcgcgggacaggagcucagggcgagacccucggugaaaaguggaaacggcagcuuaaccagcugagcaagucagaguucaauacuuacaagagauccgggaucauggaagucgaccguagugaggccaaagaaggauugaagaggggcgagaccacaaaacacgccguuagccgggguacugcgaagcugcgcugguuuguggagcgaaaccucgucaaaccugaaggcaaggugauugauuuaggguguggaagaggcggguggucuuauuacugcgcuggacugaagaaaguaaccgaggugaagggcuauacaaaaggugggcccggacaugaagaaccgaucccaauggcaacguacggcuggaaucuuguuaagcugcacuccggcaaagacguguucuuuauaccucccgaaaagugugauacccuacucugcgacaucggggagucaagcccaaaccccacuauugaggaaggaaggacacugcgggucuugaaaaugguggagccuuggcugcgcgguaaucaauucuguaucaagauucucaacccguacaugcccucggucguggaaacccuugagcagaugcagagaaagcauggcgggaugcugguuaggaauccauuaucucgaaacaguacucacgagauguauuggguauccugcggaacaggcaauaucgugagcgccgucaacaugaccucacggaugcuguugaaucguuuuacgauggcucacagaaaaccuaccuacgaacgcgauguggaccucggugccgggacaaggcauguugcaguggagcccgaagucgccaaccuggauauuaucggacagcggauagagaacauuaagcacgaacauaaauccacuuggcacuaugacgaggauaauccuuacaagaccugggcuuaucauggcucuuacgaggugaaaccaagcggcagugcguccagcaugguaaacggggugguuaagcuacuuacaaagcccugggacgucaucccuauggugacucaaaucgccaugaccgauacaaccccauucggacagcagagaguguuuaaagaaaaggucgacacucgcacgcccaaagcaaagagggguacagcucaaauuauggagguuaccgccaaauggcuguggggcuuccucucucgaaauaagaagccgcggauauguacuagagaagaguuuaccaggaaagugcgcucaaacgcagccaucggggcuguauucguggacgaaaaucaguggaacagugccaaggaggcggucgaggaugaacguuuuugggaccuggugcaccgggagagagaauugcacaaacagggaaagugcgcaacaugcguuuauaauaugaugggcaaaagggagaagaagcugggugaguucgggaaagccaagggaucccgcgcuauuugguacauguggcucggcgcccgauuucuugaguucgaggcacugggcuucaugaacgaagaucauugguuuagccgggaaaauucuuuaucggggguggaaggagagggucugcacaaauugggcuacauccucagagacauuucaaagaucccugggggaaacauguaugcugaugacacggccggcugggauaccaggauaacugaggacgaucugcagaaugaagcucgcaucacagacauuauggagccagaacaugcccuacuugcaaaaagcaucuucaagcugaccuaccaaaacaaagucgugagaguacagcggcccgcgaagaaugguacuguuauggaugugauuuccaggcgugaccagcgagggaguggacaggucggcacauauggccucaacaccuuuacaaauauggaggcccaacugauccgccagauggaaucugaggggauauucagcccuuccgaguuggaaacuccaaacuuagcugagagagugcugguguggcucgaaaaguacggagucgagcggcuuaaaaggauggccauuucaggugaugacuguguugugaagcccaucgacgaucgcuuugcaaccgcucugacggcccuaaacgacaugggcaaaguaagaaaggauaucccgcagugggaaccuaguaaaggguggaaugacuggcagcaagugcccuucugcucucaccacuuucaucagcugauuaugaaggauggacgggagauagucgugccauguaggaaccaggacgagcucguuggccgagcacgugugagccagggugccgggugguccuugagagaaaccgcgugccugggaaagucauaugcucaaauguggcagcuuauguacuuccaccgccgggaucugaggcucgccgcaaaugccaucuguagcgcugucccuguggacuggauucccacaucuagaacuaccugguccauccaugcccaccaucaguggaugacaacugaggauauguuaaguguauggaaccgcguuuggauugaagagaauccauggauggaagacaaaacccacaucagcucguggggcgaugugcccuaucugggcaagcgggaggaccaauggugcggguccuugauaggacugacggcaagggcuacaugggccaccaacauccaggucgcgauuaaucaggugcgaagacucaucgguaacgagaauuaccuugacuacaugacuucuaugaaacgguuuaagaacgaaucagauccugagggcgcucugugguga

SEQ ID NO: 13260 - RNA, 9879 nt, Artificial Sequence
  derived and/or modified CDS sequence (opt3) from DENV-1__GU131894__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccuggcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcuuaaguugagggauuccuauacacaggucugcgaccaccgucucaugucagcagccaucaaagauaguaaggcugugcacgccgacaugggguacuggauugaaucugagaaaaaugaaacguggaagcuggcacgggcgagcuucaucgagguuaagaccuguauauggccaaaaucccauacucuauggucaaacggagugcuggaaagcgagaugaucauucccaagaucuauggcgguccuauuucucaacacaauuaccgaccaggcuacuucacacagaccgccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggaaaaugcucaugaccgggacucuggccgucuuccuacugcucaucaugggacagcugacauggaacgaucuuauucguuugugcauaauggugggcgcaaaugcuucugacagaauggggaugggaaccacauaccuggccuuaauggcaacuuuuaagaugaggccuauguucgccguuggccuccuguuucgccggcuuaccagcagagaggugcugcuacucacgaucggucugucauuggucgcuaguguggaacugccaaacuccuuagaggaacucggggauggacuggcgaugggcauuaugauccuuaaacuguugacagacuuccaaucucaucagcucugggccacccugcuaagccugacuuuuauuaagaccacauucucccuucacuaugcauggaaaacuauggcuaugguucucucaaucgugagccuguuucccuugugucugaguaccacgucucagaagacaaccugguuaccgguccuccugggcucccuugggugcaagccucugacuauguucuugauagccgagaauaaaaucuggggaaggcgaagcuggccacucaacgaagguauuauggccguaggcaucgugucgauucugcuaucaucucugcuuaagaacgauguuccccucgcugggccucugaucgcaggaggcauguugauagccuguuacgugauuagugguuccagcgcggacuuaucucuggagaaagcugccgaggucagcugggaagaggaagcagagcauuccggggccucacacaauauccucguggaaguacaggaugacggaacaaugaagaucaaagaugaggagcgcgacgauacccugacuauucuucugaaggcuacauugcuagcagugaguggcgucuauccccugagcauaccagccacccucuuuguuugguacuucuggcagaaaaagaagcagcggucuggcgugcugugggacacgccuucacccccagaaguggagagagcgguccuugaugacgggaucuauaggauuaugcagcguggauuacugggucgcagccaggugggcguugggguauuccaagaaaacguguuucauacuauguggcacgucacccggggagcugugcucauguaccagggcaaaagauuggagccgaguugggccagcguuaagaaagaccugaucuccuacggugggggauggaggcuccagggcucuuggaauacaggcgaggaagugcaggucauugcaguggagccugggaagaaccccaaaaauguacaaaccgccccaggaacauucaagacucccgaaggugaggucggcgcuaucgcccuggauuuuaagccugggaccucgggaagcccaauagugaaccgagaaggcaaaaucguuggucuuuaugggaauggaguggucacgacaucaggcacuuacguguccgcaauugcucaggccaaggcgagucaggagggcccccugccugagaucgaagacgagguuuuccggaaacgcaacuugaccauuauggaucuacacccggggucuggaaagacaagaagguaucugccagccaucgugcgggaagcaauaaaacgaaagcucagaaccuuaauucuggcucccacucgcgucguggccagcgagauggcugaagcacuuaaggguaugccuaucagguaccaaaccacagccguaaaauccgagcauacgggcaaggagaucguggaccugaugugccacgccacuuuuaccaugcgucucuugucaccaguucggguccccaauuauaacaugauuaucauggaugaagcucauuucacagacccuucuagcauagcggcaagaggguacauuaguaccagggugggaaugggcgaggccgcugccaucuuuaugacugcaacaccgcccgguuccguggaagccuucccacagagcaaugcugucauucaggaugaggaacgcgacaucccugagcgaucuuggaacucaggguaugaguggauaaccgauuuucccggaaaaacgguaugguucgugccauccauuaagaguggcaaugacaucgcgaacugucugaggaaaaauggcaagcggguuauccagcucagcaggaagacuuuugauacagaauaccagaaaaccaagaacaacgacugggacuacguggucaccacugauauuucggagaugggggccaauuuccgcgcagaccgugugaucgauccuagacggugccugaaacccguuauucuuaaggacggaccagaaagggugauacuagcugguccgaugccugucacaguggccucugcagcccagcgccgaggcagaaucgggcggaaccacaauaaagagggagaucaguauauuuacaugggccagccccugaacaaugacgaggaucaugcucacuggaccgaagccaagauguuguuagacaacaucaauacaccagaggguaucauucccgcgcuguucgaaccugagagggaaaaguccgcagccauagauggggaguaucgccucagaggcgaggcuaggaaaacuuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacgaaagagggagaaaggaagaaauugcggccccgcuggcuggacgcuagaaccuacucugacccucuagcacugagggaguucaaggaauuugccgcuggucggcgauccgugagcggcgaucucauucuugagaucgggaaacugccgcagcacuuaacacagagagcccaaaaugcauuggacaaccuggucaugcuccauaauucagaacagggaggccgcgcguauaggcacgccauggaggagcugccagauacuauugaaacccuuaugcugcucgcuuugaucgccguucugacagguggggugaccuuauucuuucuaaguggccggggacugggcaagacuagcauagggcuccuuuguguaauggcauccucugugcuguuguggauggcuagcgucgagccccauuggaucgccgcauccauuauccuggaguucuuucucauggugcugcuuauuccugagcccgaccgucagagaacgccacaggauaaccaacucgccuacguugugaucggacuguuguucaugauacugaccgucgcugcgaaugagauggguuuacuagaaacaacuaagaaagaccugggcauugggcacguagccgugggaaaccaccaucacgcagcuaugcucgauguugaccuucauccugccucagccuggacccuguacgcaguggcuacaaccaucauuacucccaugaugaggcacacaaucgagaacacgaccgccaauauaucuuugacugcgaucgcuaaccaggccgcaauucugaugggccucgauaaggguuggccaaucaguaaaauggacauuggggucccucugcuugccuuaggcugcuauucgcaagugaauccgcugacacucaccgcugcagucuugaugcugguggcccauuacgcgaucauaggacccggccuacaagcuaaggccacccgcgaagcacagaaacggacagccgcugggauuaugaagaacccaacuguugauggaaucguggccaucgaccuggauccuguaguguaugacgcaaaguuugagaaacagcucggccagauuaugcuucugaucuuguguacgagccaaauacugcucaugcgaaccacaugggcucugugcgaauccauuacuuuagccaccgguccccuuacaacccugugggaggggucuccaggaaaguucuggaauacuacgaucgcggucucaauggccaacauuuuuagaggcagcuaccucgcaggagcuggccuagccuucucccugaugaaaagucuagggggaggcaggcgcgggacaggagcacagggcgagacccugggugaaaaguggaaacggcagcucaaucagcuuucuaagagcgaguucaacacuuauaagagaucagggaucauggaaguugaccguuccgaggcuaaagaaggacugaagaggggcgagaccacaaaacacgccgugagucgggguacugccaaguugcgcugguuugucgagcgaaaucuggugaaaccugaaggcaagguaauagaucucggguguggaagaggcggguggagcuacuauugcgcgggauuaaagaaagugaccgagguuaagggcuacacaaaaggugggcccggacacgaagaaccgaucccaauggcuacguacggcuggaaccuggugaaacuucauucuggcaaagacgucuucuuuauuccucccgaaaagugugauacccugcuaugcgacaucggggaguccucaccaaaucccacuauugaggaaggaaggacacuccgggugcugaaaauggucgagccuugguugcgcgguaaccaauucuguaucaagauucugaauccguauaugcccagcgugguugaaacccucgagcagaugcagagaaagcacggcgggaugcuuguaaggaacccacugucgcgaaauucuacucaugagauguacugggugaguugcggaacaggcaacaucgucuccgcagugaauaugaccagccggauguuacugaaccguuuuacgauggcccacagaaaaccuaccuaugaacgcgauguugacuugggugcugggacaaggcacguggccgucgagcccgaaguggcaaaccucgauauaauuggacagcggaucgagaauaucaagcaugaacacaaaucaacuuggcauuacgacgaggauaacccuuauaagaccugggccuaccacggcuccuaugagguaaaaccaucuggcagcgcuaguuccauggugaaugggguugucaagcugcuaacaaagcccugggacgugauuccuauggugacucaaauagcgaugaccgauacaaccccauucggacagcagagagucuuuaaagaaaagguugacacucgcacgcccaaagccaagagggguacagcacaaaucauggaggugaccgcuaaauggcuuuggggcuuccugagccgaaacaagaagccgcggauuuguacuagagaagaguuuaccaggaaaguacgcucuaaugccgcaaucggggccguguucgucgacgaaaaccaguggaacucagcuaaggaggccguggaggaugaacguuuuugggaccucguucauaaagagcgggaacugcacaagcagggaaaaugcgcgacaugcguguacaacaugaugggcaagagagagaagaaauugggugaguucgggaaggcaaaaggaaguagggccauuugguacauguggcugggcgcucgcuuucucgaguucgaggcccuuggcuucaugaaugaagaucacugguuuucccgagagaacagccugucuggggucgaaggagaggguuuacauaagcugggcuauaucuugcgggacauaucgaaaaucccugggggaaauauguacgcagaugacacggcuggcugggauaccagaauuacugaggacgaucuccagaacgaagccaggaucacagacauuauggagccagaacacgcucugcuagccaagucaaucuucaaacuuaccuaucaaaauaaggugguacgcguucagagacccgcaaagaacgguacugugauggaugucauaagccggagggaccagcguggguccggacaggugggcacauacggccugaauaccuuuacaaacauggaggcgcaacucauucgacagauggaaagugaggggaucuucucuccuagcgagcuggaaacuccaaacuuggccgagcgcguguuagauuggcuggaaaaauauggagucgagagacucaagcggauggcuaucuccggugacgacuguguugugaaacccauugaugacagguuugccaccgcacuuacggcucugaaugauaugggcaagguacgcaaagacauaccgcagugggaaccuucaaagggguggaacgauuggcagcaagugcccuucugcagucaucacuuucaccagcuaaucaugaaggacggaagagagauugucgugccaugucggaaucaggaugagcugguuggcagggcccgagugucucagggugcaggguggagccuccgugaaaccgccugcuugggaaaauccuacgcgcaaauguggcagcugauguauuuccauagacgcgaccuucggcuggcugccaacgcaaucuguucagccgucccuguggauuggacacccacuagcaggaccacauggucuauucacgcucaucaccaguggaugacuaccgaggacaugcucuccguauggaauagaguuuggaucgaagagaacccauggauggaagauaagacgcauauaaguagcuggggcgacgugcccuacuuaggcaaacgcgaggaccaauggugcgggucgcugaucggauugacagcccgggcaaccugggcuacuaauauucaggucgccaucaaccaggugaggcgacugauugguaaugagaacuaccucgauuauaugacauccaugaagagauuuaaaaaugaaucugacccugagggcgcgcuuugguga

SEQ ID NO: 13261 - RNA, 9879 nt, Artificial Sequence
  derived and/or modified CDS sequence (opt3) from DENV-1__GU131895__SS-prME
uccgugaccaugcugcucaugcuuaugcccacagcacuggcuuuccacuugacuacgagaggaggggaaccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuagcucucaaggggauguccuaugucauguguacagguagcuucaaacuggagaaggaaguggcggagacucagcacggaaccguccuugugcagaucaaguacgagggcacggacgcaccuugcaaaauuccauucucgacacaagaugaaaaggggguuacccagaacggacgcuugaucacugccaaucccauagugacagacaaagagaagccuguaaacauugaagcugagccacccuuuggcgagucuuauaucgucaucggugccggggaaaaagcacugaagcucuccugguucaagaaaggcucaaguauuggaaagauguuugaggccaccgcuagaggcgccaggcggauggcaauccugggggauacugcgugggacuucggaagcauugguggcguguuuaccuccguugggaaacuugugcaucagauauucggaacagcuuacggcguccuguuuucuggugugagcuggacgaugaagaucgggauuggcguauugcucaccuggcugggauuaaauucacgaaguacuucccugagcaugacauguaucgccgugggccuaguuacccucuaccugggggucauggugcaggcagauucuggaugcgugaucaacuggaaaggccgcgaacuuaagugugguucagggauuuucgucacaaaugagguucacacuuggaccgaacaauauaaguuucaggccgacaguccgaaaagauugagcgcugccauaggaaaggcaugggaggagggcgugugcgguaucagguccgcuacgcggcuggaaaacauuauguggaaacagaucucuaacgagcucaaucauauucuguuagaaaacgacaugaaguucacagugguagucggcgauguggccgggauccuggcgcagggcaagaagaugauacgcccucaacccauggaguacaaauauucguggaaaagcuggggcaaggccaagaucauuggggcugacguucagaauaccacuuuuaucauugauggaccaaacaccccugaaugucccgacgaucagagagcauggaauaucugggagguggaggacuacggcuucgguauauuuacaacuaacauuuggcuuaaguugagggauuccuauacccaggucugcgaccaccgucucaugucagccgcuaucaaagauaguaaggccgugcacgcagacaugggguacuggauugaaucugagaaaaaugaaacauggaagcuggcgcgggccagcuucaucgagguuaagacguguauauggccaaaaucccauacccuauggucaaacggagugcuggaaagcgagaugaucauucccaagaucuauggcgguccuauuucucaacacaauuaccgaccaggcuacuucacucagacagcugggccguggcaucucggaaaacuggagcuugauuuugacuugugcgaaggcaccacuguagucguggaugagcacugcgggaacagaggacccucccugaggacaaccacggugacuggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacagggacccuggcagucuuccuacugcucaucaugggacagcugacuuggaacgaucuuauucguuugugcauaauggugggcgcuaaugccucugacagaauggggaugggaacaaccuaccuggcauuaauggccacauuuaagaugaggccuauguucgcuguuggccuccuguuucgccggcuuacuagcagagaggugcugcuacucaccaucggucugucauuggucgcgaguguggaacugccaaacuccuuagaggaacucggggauggacuggccaugggcauuaugauccuuaaacuguugacggacuuccaaucucaucagcucugggcaacacugcuaagccugaccuuuauuaagacuaccuucucccuucacuaugcuuggaaaacaauggccaugguucucucaaucgugagccuguuucccuugugucugaguacuaccucucagaagacgacaugguuaccgguccuccugggcucccuugggugcaagccucugaccauguucuugauagccgagaauaaaaucuggggaaggcgaagcuggccacucaacgaagguauuauggcuguaggcaucgugucgauucugcuaucaucucugcuuaagaacgauguuccccucgcagggccucugaucgccggaggcauguugauagcguguuacgugauuagugguuccagcgcugacuuaucucuggagaaagccgcagaggucagcugggaagaggaagccgagcauuccggggcuucacacaauauccucguggaaguacaggaugacggaacuaugaagaucaaagaugaggagcgcgacgauacacugaccauucuucugaaggcaacuuugcuagccgugaguggcgucuauccccugagcauaccagcgacacucuuuguuugguacuucuggcagaaaaagaagcagcggucuggcgugcugugggacaccccuucacccccagaaguggagagagcuguccuugaugacgggaucuauaggauuaugcagcguggauuacugggucgcagccaggugggcguugggguauuccaagaaaacguguuucauacgauguggcacgucacucggggagccgugcucauguaccagggcaaaagauuggagccgaguugggcaagcguuaagaaagaccugaucuccuacggugggggauggaggcuccagggcucuuggaauaccggcgaggaagugcaggucauugccguggagccugggaagaaccccaaaaauguacaaacagcuccaggaaccuucaagacacccgaaggugaggucggcgccaucgcacuggauuuuaagccugggacuucgggaagcccaauagugaaccgagaaggcaaaaucguuggucuuuaugggaauggaguggucaccacgucaggcacauacguguccgcuauugcccaggcgaaggccagucaggagggcccccugccugagaucgaagacgagguuuuccggaaacgcaacuugacuauuauggaucuacacccggggucuggaaagaccagaagguaucugccagcaaucgugcgggaagcuauaaaacgaaagcucagaacauuaauucuggcccccacccgcgucguggcuagcgagauggcagaagcccuuaaggguaugccuaucagguaccaaacuaccgccguaaaauccgagcauacaggcaaggagaucguggaccugaugugccacgcuacguuuacuaugcgucucuugucaccaguucggguccccaauuauaacaugauuaucauggaugaagcgcauuucaccgacccuucuagcauagcagccagaggguacauuaguacaagggugggaaugggcgaggcugccgcaaucuuuaugaccgccacuccgcccgguuccguggaggcuuucccacagagcaaugcggucauucaggaugaggaacgcgacaucccugagcgaucuuggaacucaggguaugaguggauaacagauuuucccggaaaaaccguaugguucgugccauccauuaagaguggcaaugacaucgccaacugucugaggaaaaauggcaagcggguuauccagcucagcaggaagacguuugauacugaauaccagaaaacaaagaacaacgacugggacuacguggucaccaccgauauuucggagaugggggcaaauuuccgcgcugaccgugugaucgauccuagacggugccugaaacccguuauucuuaaggacggaccagaaagggugauacuagccgguccgaugccugucacuguggcaucugccgcucagcgccgaggcagaaucgggcggaaccacaauaaagagggagaucaguauauuuacaugggccagccccugaacaaugacgaggaucaugcccacuggacagaagcgaagauguuguuagacaacaucaauaccccagaggguaucauucccgcacuguucgaaccugagagggaaaaguccgccgcuauagauggggaguaucgccucagaggcgaggccaggaaaacauuuguagaacugaugcggcguggagaccuuccaguguggcugagcuacaagguugcuucagagggcuuccaauauagugaucgccgauggugcuuugacggggaaagaaacaaucagguccucgaggaaaacauggauguggagaucuggacuaaagagggagaaaggaagaaauugcggccccgcuggcuggacgcaagaacguacucugacccucuagcccugagggaguucaaggaauuugcugccggucggcgauccgugagcggcgaucucauucuugagaucgggaaacugccgcagcacuuaacccagagagcacaaaaugcguuggacaaccuggucaugcuccauaauucagaacagggaggccgcgccuauaggcacgcuauggaggagcugccagauacaauugaaacucuuaugcugcucgccuugaucgcaguucugaccgguggggugacauuauucuuucuaaguggccggggacugggcaagaccagcauagggcuccuuuguguaauggcuuccucugugcuguuguggauggccagcgucgagccccauuggaucgcagccuccauuauccuggaguucuuucucauggugcugcuuauuccugagcccgaccgucagagaacuccacaggauaaccaacucgcuuacguugugaucggacuguuguucaugauacugacggucgcggccaaugagauggguuuacuagaaaccacaaagaaagaccugggcauugggcacguagcagugggaaaccaccaucacgcugccaugcucgauguugaccuucauccugccucagcauggacucuguacgcuguggccaccacaaucauuacccccaugaugaggcacacuaucgagaacacaacggcgaauauaucuuugaccgcuaucgccaaccaggcagccauucugaugggccucgauaaggguuggccaaucaguaaaauggacauuggggucccucugcuugcuuuaggcugcuauucgcaagugaauccgcugacucucacagcagccgucuugaugcugguggcgcauuacgcuaucauaggacccggccuacaagccaaggcaacccgcgaagcccagaaacggaccgcugccgggauuaugaagaacccaacaguugauggaaucguggcaaucgaccuggauccuguaguguaugacgcuaaguuugagaaacagcucggccagauuaugcuucugaucuuguguacuagccaaauacugcucaugcgaacgaccugggcccugugcgaauccauuacauuagcgacugguccccuuaccacacugugggaggggucuccaggaaaguucuggaauaccacuaucgccgucucaauggcaaacauuuuuagaggcagcuaccucgcuggugccggccuagcauucucccugaugaaaagucuagggggaggcaggcgcgggacgggagcucagggcgagacacugggugaaaaguggaaacggcagcucaaucagcuuucuaagagcgaguucaacaccuauaagagaucagggaucauggaaguugaccguuccgaggccaaagaaggacugaagaggggcgagacuaccaaacacgccgugagucgggguacagcgaaguugcgcugguuugucgagcgaaaucuggugaaaccugaaggcaagguaauagaucucggguguggaagaggcggguggagcuacuauugcgcuggauuaaagaaagugacugagguuaagggcuacaccaaaggugggcccggacacgaagaaccgaucccaauggcaacauacggcuggaaccuggugaaacuucauucuggcaaagacgucuucuuuauuccucccgaaaagugugauacgcugcuaugcgacaucggggaguccucaccaaaucccaccauugaggaaggaaggacucuccgggugcugaaaauggucgagccuugguugcgcgguaaccaauucuguaucaagauucugaauccguauaugcccagcgugguugaaacacucgagcagaugcagagaaagcacggcgggaugcuuguaaggaacccacugucgcgaaauucuacccaugagauguacugggugaguugcggaacuggcaacaucgucuccgccgugaauaugacaagccggauguuacugaaccguuuuaccauggcucacagaaaaccuacguaugaacgcgauguugacuugggugccgggaccaggcacguggcagucgagcccgaaguggccaaccucgauauaauuggacagcggaucgagaauaucaagcaugaacacaaaucaacauggcauuacgacgaggauaacccuuauaagacuugggcuuaccacggcuccuaugagguaaaaccaucuggcagcgcgaguuccauggugaaugggguugucaagcugcuaaccaagcccugggacgugauuccuauggugacacaaauagccaugacugauaccacaccauucggacagcagagagucuuuaaagaaaagguugacacccgcacucccaaagcaaagagggguacggcucaaaucauggaggugacagccaaauggcuuuggggcuuccugagccgaaacaagaagccgcggauuuguaccagagaagaguuuacuaggaaaguacgcucuaaugcagccaucggggcuguguucgucgacgaaaaccaguggaacucagccaaggaggcgguggaggaugaacguuuuugggaccucguucauaaagagcgggaacugcacaagcagggaaaaugcgcaaccugcguguacaacaugaugggcaagagagagaagaaauugggugaguucgggaaggccaaaggaaguagggcuauuugguacauguggcugggcgcccgcuuucucgaguucgaggcacuuggcuucaugaaugaagaucacugguuuucccgagagaacagccugucuggggucgaaggagaggguuuacauaagcugggcuauaucuugcgggacauaucgaaaaucccugggggaaauauguacgcugaugacacagccggcugggauacgagaauuaccgaggacgaucuccagaacgaagcuaggaucacugacauuauggagccagaacacgcccugcuagcaaagucaaucuucaaacuuacauaucaaaauaaggugguacgcguucagagacccgcgaagaacgguaccgugauggaugucauaagccggagggaccagcguggguccggacaggugggcacuuacggccugaauacauuuaccaacauggaggcccaacucauucgacagauggaaagugaggggaucuucucuccuagcgagcuggaaacaccaaacuuggcugagcgcguguuagauuggcuggaaaaauauggagucgagagacucaagcggauggccaucuccggugacgacuguguugugaaacccauugaugacagguuugcaacugcucuuaccgcccugaaugauaugggcaagguacgcaaagacauaccgcagugggaaccuucaaagggguggaacgauuggcagcaagugcccuucugcagucaucacuuucaccagcuaaucaugaaggacggaagagagauugucgugccaugucggaaucaggaugagcugguuggcagggcacgagugucucagggugccggguggagccuccgugaaacggcgugcuugggaaaauccuacgcucaaauguggcagcugauguauuuccauagacgcgaccuucggcuggccgcaaacgccaucuguucagcugucccuguggauuggauucccaccagcaggacaacuuggucuauccacgcccaucaccaguggaugaccacagaggacaugcucuccguauggaauagaguuuggauagaagagaacccauggauggaagauaagacucauaucaguagcuggggcgacgugcccuacuuaggcaaacgcgaggaccaauggugcgggucgcugauuggauugaccgcacgggcuacgugggccacaaauauccaggucgcgauuaaccaggugaggcgacugaucgguaaugagaacuaccucgauuauaugaccuccaugaagagauuuaaaaaugaaucugacccugagggcgcucuuugguga

SEQ ID NO: 13262 - RNA, 9879 nt, Artificial Sequence
  derived and/or modified CDS sequence (opt3) from DENV-1__GQ868632__SS-prME
agcgugaccaugcugcucaugcuuaugcccacagcacuggcuuuccacuugacuacgcggggaggggagccucauaugaucgucuccaagcaggaaaggggaaaaucuuuacuguuuaagaccucagccgguguuaauaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaagggggucuccuaugugauguguacugguagcuucaaacuggagaaggaagucgcugagacccagcacgguacggugcuuguucagaucaaguacgagggcacagacgcgccuugcaaaauuccauucucgacccaagaugaaaagggggugacucagaacggacgcuugaucacagcaaaucccauaguaaccgacaaagagaagccugucaacauugaagccgagccacccuuuggcgagucuuauaucgugaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguuuuuacauccguggggaaacuuguccaucagauauucggaacggcguacggcgugcuguuuucugguguaagcuggaccaugaagaucgggauuggcguguugcucacuuggcugggauuaaauucacgaaguacaucccugagcaugaccuguaucgcuguuggccuagucacacucuaccugggggugauggugcaggccgauucuggaugcgucaucaacuggaaaggccgcgaacuuaagugugguucagggauuuucguuacuaaugaggugcacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccguagucgugggcgauguugcugggauccuggcccagggcaagaagaugauacgcccucaacccauggaguacaaauauucguggaaaagcuggggcaaggcgaagaucauuggggccgacgugcagaauacuaccuuuaucauugauggaccaaacacaccugaaugucccgacgagcagagagcuuggaauaucugggaggucgaagauuacggcuucgguauauuuacuaccaacauuuggcuuaaguugagggacuccuauacacaggugugcgaucaccgucucaugucagcagccaucaaagacaguaaggcuguucacgccgauaugggguacuggauugagucugagaaaaaugagacguggaagcuggcacgggcgagcuucaucgaagugaagaccuguauauggccaaaaucccauacucuauggucaaacggaguacuggagagcgagaugaucauucccaagaucuauggcgguccuauuucucaacacaauuaccgaccaggcuacuucacacagaccgccgggccguggcaucucggaaaacuggaacuugacuuugauuugugcgagggcacuacagucgugguggacgaacacugcgggaacagaggacccucccugaggaccacgacugucaccggcaagaucauacacgagugguguugccgcaguuguacauuaccuccacuccgguucagaggugaggaugggugcugguauggaauggaaauuaggcccguuaaagagcgcgaagagaaucuggugaaguccaugguaucugcuggcuccggugaaguggacucauuuagucuuggccuguuguguaucagcaucaugauugaggaggucaugcgaucgcgguggucccguaagaugcucaugaccgggacucuggccguguuccuacugcucaucaugggacagcugacauggaacgaccuuauuagauugugcauaaugguuggcgcaaaugcuucugauaggauggggaugggaaccacauaccuggccuuaauggcaacuuuuaaaaugcgcccuauguucgccgugggccuccuguuucggagacuuaccagcagggaaguccugcuacucacgaucggucugucauugguggcuaguguugagcugccaaacuccuuagaagaacucggggacggacuggcgaugggcauuaugauccuuaagcuguugacagauuuccaaucucaucagcucugggccacccugcuaagccugacuuuuauuaaaaccacauucucccuucacuaugcauggaagacuauggcuauggugcucucaaucgucagccuguuucccuugugucugaguaccacgucucagaaaacaaccugguuaccgguacuccugggcucccuugggugcaagccucugacuauguucuugauagccgaaaauaagaucuggggacgacgcagcuggccacucaacgaggguauuauggccgugggcaucguuucgauucugcuaucaucuuuucugaaaaacgacgugccccuugcugggccucucaucgcaggaggcaugcugauagccuguuacgucauuagugguuccagcgcggauuugucuuuagagaaggcugccgaagugagcugggaggaagaggcagaacauuccggggccucacacaauauccugguagaggugcaggacgauggaacaaugaaaaucaaggacgaggaacgggaugacacccucacuauucugcuuaaagcuacacuguuggcagucaguggcguuuauccccuaagcauaccagccacccuguucgugugguacuucuggcaaaagaaaaagcagagaucuggcgugcucugggauacgccuucacccccagaggucgaaagggcggugcuggacgaugggaucuaucguauuaugcagcgcggacuuuuaggucggagccagguuggcguagggguguuucaagagaacgucuuccauacuauguggcacgugaccagaggagcuguucugauguaccagggcaagaggcucgagccgaguugggccagcgugaaaaaggacuugaucuccuacggugggggauggcgacugcagggcucuuggaauacaggcgaagagguccaggugauugcaguagaaccugggaaaaaccccaagaauguccaaaccgccccaggaacauuuaaaacucccgagggugaagugggcgcuaucgcccucgacuucaagccugggaccucgggaagcccaauaguuaaccgggagggcaagaucgugggucuguaugggaauggagucgugacgacaucaggcacuuacguuuccgcaauugcucaggccaaagcgagucaggagggcccccuuccugaaaucgaggaugaaguguuucgcaagagaaaccugaccauuauggacuugcacccggggucuggaaaaacaaggcgguaucuaccagccaucguccgagaggcaauaaagagaaaacugcgcacccucauuuuagcucccacuagggugguagccagcgaaauggcugaggcacugaaggguaugccuauccguuaccaaaccacagccgugaaguccgagcauacgggcaaagaaaucguugaucuuaugugccacgccacuuucaccaugcggcugcucucaccagucagagugcccaauuauaacaugauuaucauggacgaggcucauuuuacagauccuucuagcauagcggcaaggggguacauuaguacccgcgugggaaugggcgaagccgcugccaucuucaugacugcaacaccgcccgguuccgucgaggccuuuccacagagcaaugcuguaauucaggacgaagaacgagauaucccugagagaucuuggaacucaggguaugaauggauaaccgacuuccccggaaagacggugugguuuguuccauccauuaaaaguggcaaugauaucgcgaacuguuugcggaagaauggcaaaagggugauccagcugagccgcaagacuuucgacacagaguaccaaaagaccaaaaacaacgauugggacuacgucgugaccacugacauuucggaaaugggggccaauuuccgugcagauagaguuaucgacccucggaggugccucaagcccgugauucugaaagauggaccagagcgcgucauacuugcugguccgaugccugugacaguagccucugcagcccagcgaagaggccggaucgggaggaaccacaauaaggagggagaccaguauauuuacaugggccagccccuaaacaaugaugaagaccaugcucacuggaccgaggccaaaaugcuguuggauaacaucaauacaccagaagguaucauucccgcguuauuugagccugaacgcgagaaguccgcagccauagacggggaguauagacugaggggcgaagcucggaagacuuucguggagcucaugcgucgcggagaucugccaguuuggcuuagcuacaaagucgccucagaaggcuuucaauauagugaccgaagauggugcuucgauggggagaggaacaaucaggugcuggaagagaacauggacguggagaucuggacgaaggaaggagagcggaaaaagcuccgccccagaugguuggaugcuaggaccuacucugacccucuggcacuacgggaauuuaaagaguucgccgcuggucgaagauccgucagcggcgaccugauucucgaaaucgggaaacuuccgcagcaccugacacagcgcgcccaaaaugcauuagauaacuugguuaugcugcauaauucagagcagggaggcagggcguaucggcacgccauggaggaacucccagacacuauugagacccugaugcuucuggcucucaucgccguguugacaggugggguaacccuguuuuucuuaaguggccguggacuaggcaaaacuagcauagggcugcucugugugauggcauccucuguccuucuguggauggcuagcguggaaccccauuggaucgccgcauccauuaucuuggaguuuuuccugaugguucuccugauuccugagcccgauagacagaggacgccacaggacaaccaacuugccuacguggucaucggacuccuguuuaugauauugaccguagcugcgaaugaaaugggucuguuagagacaacuaagaaggaucuaggcauugggcacguggccguuggaaaccaccaucacgcagcuaugcuggacguggaucuccauccugccucagccuggacccuuuacgcagucgcuacaaccaucauuacucccaugaugcgccacacaaucgaaaacacgaccgccaauauaucucugacugcgaucgcuaaccaggccgcaauuuugaugggccuggacaaagguuggccaaucaguaagauggauauuggggugccucuccuggcccuuggcugcuauucgcaggucaauccguuaacacugaccgcugcagugcucauguugguugcccauuacgcgaucauaggacccggccugcaagcuaaagccacccgggaggcacagaagcgaacagccgcugggauuaugaaaaacccaacuguggacggaaucguagccaucgaucuagacccuguggucuaugaugcaaaguucgaaaagcagcugggccagauuaugcuccuuauccuguguacgagccaaauauugcugaugagaaccacaugggcucucugcgaguccauuacucuggccaccggucccuuaacaacccuuugggaggggucuccaggaaaauuuuggaauacuacgaucgcgguuucaauggccaacauuuucaggggcagcuaccuggcaggagcuggccucgccuucucccuaaugaagagucuagggggaggccgccgggggacaggagcacagggcgaaaccuugggugagaaauggaagagacagcugaaucagcucucuaaaagcgaauuuaacacuuauaagcguucagggaucauggagguggacagguccgaagcuaaggagggacuuaaacggggcgagaccacaaagcacgccgucagucgcgguacugccaaacugcgaugguucguggaaagaaauuugguaaagccugagggcaaagugauagaccugggguguggaaggggcggguggagcuacuauugcgcgggacucaagaagguuaccgaagugaaaggcuacacaaagggugggcccggacacgaggaaccgaucccaauggcuacguacggcuggaacuuagucaaacugcauucuggcaaggauguguuuuucauuccucccgagaaaugugacacccuucugugcgauaucggggaguccucaccaaaucccacuauugaagagggacggacacuacgcguccucaagaugguggaaccuuggcugagagguaaccaauuuuguaucaaaauuuugaauccguauaugcccagcguuguagagacccuggagcagaugcagaggaagcacggcgggaugcucgugcgaaacccacuuucgagaaauucuacucaugaaauguacugggucaguugcggaacaggcaacaucguguccgcaguuaauaugaccagccguaugcuguuaaacagauucacgauggcccaccgcaagccuaccuaugagagggacguggaucugggugcugggacacggcacgucgccguggaacccgagguagcaaacuuggacauaauuggacagagaaucgaaaauaucaaacaugagcacaagucaacuuggcauuacgaugaggacaacccuuauaaaaccugggccuaccacggcuccuaugaagugaagccaucuggcagcgcuaguuccaugguuaauggggucgugaaacuccugacaaagcccugggaugugauuccuauggucacucaaauagcgaugaccgacacaaccccauuuggacagcagcgcguuuucaaggagaaaguggauacuaggacgcccaaggccaaacgagguacagcacaaaucauggaaguaaccgcuaaguggcuauggggcuuucuuagccggaacaaaaagccgagaauuuguacuagggaggaguucacccgcaaggugcguucuaaugccgcaaucggggccgucuuuguggacgagaaccaguggaacucagcuaaagaggccguugaagacgagcgguucugggaucuggugcauaaggaaagagagcuccacaaacagggaaagugcgcgacaugcgucuacaacaugaugggcaaaagggaaaagaagcugggugaguuugggaaagcaaagggaagucgcgccauuugguacaugugguugggcgcucgauuccuggaguucgaagcccucggcuuuaugaaugaggaccacugguucucccgggaaaacagccuuucugggguggagggagagggucugcauaaauuaggcuauauccugagagauauaucgaagaucccugggggaaauauguacgcagacgauacggcuggcugggacaccaggauuacugaagaugacuugcagaacgaggcccgcaucacagauauuauggaaccagagcacgcucuccuggccaaaucaaucuuuaagcuaaccuaucaaaauaaaguaguuagagugcagcggcccgcaaagaacgguacugucauggacgugauaagcaggcgugaucagcgaggguccggacaggugggcacauacggccuuaauaccuucacaaacauggaagcgcaacugauucgccagauggagagugaggggaucuuuucuccuagcgaacucgagacuccaaaccuggccgaaagagucuuggacugguuagagaaguauggaguugaacggcugaaaaggauggcuaucuccggugaugacugugugguaaagcccauugacgaucgcuucgccaccgcacucacggcucuuaaugacaugggcaaagugagaaaggauauaccgcagugggagccuucaaaaggguggaacgacuggcagcaaguccccuuuugcagucaucacuuccaccagcugaucaugaaggauggacgggagauugugguuccauguaggaaucaggacgagcuggugggccgagcccgugucucucagggugcaggguggagccugagagagaccgccugccucggaaaguccuacgcgcaaauguggcaguugauguauuuucaucgccgggaucugaggcuugcugccaacgcaaucuguucagccgugccuguagacuggauucccacaagcagaacuaccuggucuauccacgcucaucaccaguggaugacaacugaagauaugcuguccguuuggaaucgcguguggauagaggaaaacccauggauggaggacaaaacccauaucaguagcuggggcgauguccccuaccucggcaagcgggaggaccaauggugcgggucguuaauuggacugacggccagggcaacaugggcuaccaauauccagguggccauuaaccagguucgaagauugaucgguaaugaaaacuaccuggacuauaugacuuccaugaaacgguucaagaaugagucugauccugaaggcgcgcucugguga

SEQ ID NO: 13263 - RNA, 9879 nt, Artificial Sequence
  derived and/or modified CDS sequence (opt3) from DENV-1__GQ868633__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaacaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccuggcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcuuaaguugagggauuccuauacacaggucugcgaccaccgucucaugucagcagccaucaaagauaguaaggcugugcacgccgacaugggguacuggauugaaucugagaaaaaugaaacguggaagcuggcacgggcgagcuucaucgagguuaagaccuguauauggccaaaaucccauacucuauggucaaacggagugcuggaaagcgagaugaucauucccaagaucuauggcgguccuauuucucaacacaauuaccgaccaggcuacuucacacagaccgccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggaaaaugcucaugaccgggacucuggccgucuuccuacugcucaucaugggacagcugacauggaacgaucuuauucguuugugcauaauggugggcgcaaaugcuucugacagaauggggaugggaaccacauaccuggccuuaauggcaacuuuuaagaugaggccuauguucgccguuggccuccuguuucgccggcuuaccagcagagaggugcugcuacucacgaucggucugucauuggucgcuaguguggaacugccaaacuccuuagaggaacucggggauggacuggcgaugggcauuaugauccuuaaacuguugacagacuuccaaucucaucagcucugggccacccugcuaagccugacuuuuauuaagaccacauucucccuucacuaugcauggaaaacuauggcuaugguucucucaaucgugagccuguuucccuugugucugaguaccacgucucagaagacaaccugguuaccgguccuccugggcucccuugggugcaagccucugacuauguucuugauagccgagaauaaaaucuggggaaggcgaagcuggccacucaacgaagguauuauggccguaggcaucgugucgauucugcuaucaucucugcuuaagaacgauguuccccucgcugggccucugaucgcaggaggcauguugauagccuguuacgugauuagugguuccagcgcggacuuaucucuggagaaagcugccgaggucagcugggaagaggaagcagagcauuccggggccucacacaauauccucguggaaguacaggaugacggaacaaugaagaucaaagaugaggagcgcgacgauacccugacuauucuucugaaggcuacauugcuagcagugaguggcgucuauccccugagcauaccagccacccucuuuguuugguacuucuggcagaaaaagaagcagcggucuggcgugcugugggacacgccuucacccccagaaguggagagagcgguccuugaugacgggaucuauaggauuaugcagcguggauuacugggucgcagccaggugggcguugggguauuccaagaaaacguguuucauacuauguggcacgucacccggggagcugugcucauguaccagggcaaaagauuggagccgaguugggccagcguuaagaaagaccugaucuccuacggugggggauggaggcuccagggcucuuggaauacaggcgaggaagugcaggucauugcaguggagccugggaagaaccccaaaaauguacaaaccgccccaggaacauucaagacucccgaaggugaggucggcgcuaucgcccuggauuuuaagccugggaccucgggaagcccaauagugaaccgagaaggcaaaaucguuggucuuuaugggaauggaguggucacgacaucaggcacuuacguguccgcaauugcucaggccaaggcgagucaggagggcccccugccugagaucgaagacgagguuuuccggaaacgcaacuugaccauuauggaucuacacccggggucuggaaagacaagaagguaucugccagccaucgugcgggaagcaauaaaacgaaagcucagaaccuuaauucuggcucccacucgcgucguggccagcgagauggcugaagcacuuaaggguaugccuaucagguaccaaaccacagccguaaaauccgagcauacgggcaaggagaucguggaccugaugugccacgccacuuuuaccaugcgucucuugucaccaguucggguccccaauuauaacaugauuaucauggaugaagcucauuucacagacccuucuagcauagcggcaagaggguacauuaguaccagggugggaaugggcgaggccgcugccaucuuuaugacugcaacaccgcccgguuccguggaagccuucccacagagcaaugcugucauucaggaugaggaacgcgacaucccugagcgaucuuggaacucaggguaugaguggauaaccgauuuucccggaaaaacgguaugguucgugccauccauuaagaguggcaaugacaucgcgaacugucugaggaaaaauggcaagcggguuauccagcucagcaggaagacuuuugauacagaauaccagaaaaccaagaacaacgacugggacuacguggucaccacugauauuucggagaugggggccaauuuccgcgcagaccgugugaucgauccuagacggugccugaaacccguuauucuuaaggacggaccagaaagggugauacuagcugguccgaugccugucacaguggccucugcagcccagcgccgaggcagaaucgggcggaaccacaauaaagagggagaucaguauauuuacaugggccagccccugaacaaugacgaggaucaugcucacuggaccgaagccaagauguuguuagacaacaucaauacaccagaggguaucauucccgcgcuguucgaaccugagagggaaaaguccgcagccauagauggggaguaucgccucagaggcgaggcuaggaaaacuuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacgaaagagggagaaaggaagaaauugcggccccgcuggcuggacgcuagaaccuacucugacccucuagcacugagggaguucaaggaauuugccgcuggucggcgauccgugagcggcgaucucauucuugagaucgggaaacugccgcagcacuuaacacagagagcccaaaaugcauuggacaaccuggucaugcuccauaauucagaacagggaggccgcgcguauaggcacgccauggaggagcugccagauacuauugaaacccuuaugcugcucgcuuugaucgccguucugacagguggggugaccuuauucuuucuaaguggccggggacugggcaagacuagcauagggcuccuuuguguaauggcauccucugugcuguuguggauggcuagcgucgagccccauuggaucgccgcauccauuauccuggaguucuuucucauggugcugcuuauuccugagcccgaccgucagagaacgccacaggauaaccaacucgccuacguugugaucggacuguuguucaugauacugaccgucgcugcgaaugagauggguuuacuagaaacaacuaagaaagaccugggcauugggcacguagccgugggaaaccaccaucacgcagcuaugcucgauguugaccuucauccugccucagccuggacccuguacgcaguggcuacaaccaucauuacucccaugaugaggcacacaaucgagaacacgaccgccaauauaucuuugacugcgaucgcuaaccaggccgcaauucugaugggccucgauaaggguuggccaaucaguaaaauggacauuggggucccucugcuugccuuaggcugcuauucgcaagugaauccgcugacacucaccgcugcagucuugaugcugguggcccauuacgcgaucauaggacccggccuacaagcuaaggccacccgcgaagcacagaaacggacagccgcugggauuaugaagaacccaacuguugauggaaucguggccaucgaccuggauccuguaguguaugacgcaaaguuugagaaacagcucggccagauuaugcuucugaucuuguguacgagccaaauacugcucaugcgaaccacaugggcucugugcgaauccauuacuuuagccaccgguccccuuacaacccugugggaggggucuccaggaaaguucuggaauacuacgaucgcggucucaauggccaacauuuuuagaggcagcuaccucgcaggagcuggccuagccuucucccugaugaaaagucuagggggaggcaggcgcgggacaggagcacagggcgagacccugggugaaaaguggaaacggcagcucaaucagcuuucuaagagcgaguucaacacuuauaagagaucagggaucauggaaguugaccguuccgaggcuaaagaaggacugaagaggggcgaggccaccaaacacgccgugagucgggguccugcgaaguugcgcugguuugucgagcgaaaucuggugaaccccgaaggcaaaguaauagaucucggguguggaagaggcggguggagcuacuauugcgcuggauuaaagaaggugacagagguuaaaggcuacacuaagggugggccgggacacgaagaaccaaucccuauggcaaccuacggcuggaaucuggugaaacuucauucuggcaaggacgucuucuuuauucccccagaaaaaugugauacacugcuaugcgacaucggggaguccucacccaacccuacgauugaggaaggaaggacccuccgggugcugaagauggucgagccgugguugcgcgguaaucaauucuguaucaaaauucugaaccccuauaugccaagcgugguugaaacucucgagcagaugcagagaaagcacggcgggaugcuuguaaggaauccucugucgcgaaacucuacacaugagauguacugggugaguugcggaaccggcaauaucgucuccgccgugaacaugacuagccggauguuacugaaccguuuuacaauggcucacagaaagcccaccuaugaacgcgauguugacuugggugccgggacgaggcacguggcagucgagccugaaguggccaaucucgauauaauuggacagcggaucgagaacaucaaacaugaacacaagucaaccuggcauuacgacgaggauaauccauauaaaacaugggcuuaccacggcuccuaugagguaaagcccucuggcagcgcgaguuccauggugaacgggguugucaaacugcuaacuaagccuugggacgugauuccaauggugacccaaauagccaugacagauacuacccccuucggacagcagagagucuuuaaggaaaaaguugacacacgcaccccgaaggcaaaaagggguacugcucaaaucauggaggugacggccaaguggcuuuggggcuuccugagccgaaauaaaaagccucggauuuguacaagagaagaguuuaccaggaagguacgcucuaacgcagccaucggggcuguguucgucgacgaaaaucaguggaacucagccaaagaggcgguggaggaugaacguuuuugggaccucguucauaaggagcgggaacugcacaaacagggaaagugcgcaacuugcguguacaauaugaugggcaaaagagagaagaaguugggugaguucgggaaagccaagggaaguagggcuauuugguacauguggcugggcgcccgcuuucucgaguucgaggcacuuggcuucaugaacgaagaucacugggucucccgagagaauagccugucugggguggaaggagaggguuuacauaaacugggcuauaucuugcgggacauaucgaagaucccagggggaaacauguacgcugaugacaccgccggcugggauacaagaauuacggaggacgaucuccagaaugaagcuaggaucaccgacauuauggagcccgaacacgcccugcuagcaaaaucaaucuuuaaacuuacuuaucaaaacaaaguaguucgcgugcagagaccugcgaagaaugguacagucauggaugugauaagccggagggaccagcguggguccggacaggugggcaccuacggccugaacacuuucacaaacauggaggcccaacucauucgacagauggaaagugaggggaucuuuucuccaagcgagcuggaaacccccaauuuggcugagcgcgucuuagauuggcuggaaaaguauggaguugagagacucaaacggauggccaucuccggugacgacugugugguaaagccgauugaugacagguucgcaacagcucuuacugcccugaacgauaugggcaaagugcgcaaggacauaccucagugggaacccucaaaaggguggaaugauuggcagcaagucccauuuuggagucaucacuuccaccagcuaaucaugaaggacggaagagagauugugguuccuugccggaaccaggaugagcuggugggcagggcacgagucucucagggugccggguggagccuccgugaaaccgcguguuugggaaaguccuacgcucaaauguggcagcugauguauuuucauagacgcgaccuucggcuggccgcaaaugccaucugcucagcugugcccguagauuggauuccaacgagcaggaccacauggucuauccacgcccaucaccaguggaugacuaccgaggacaugcucuccguuuggaacagaguguggauagaagagaaucccuggauggaagauaaaacacauaucaguagcuggggcgacgucccuuacuuaggcaagcgcgaggaccaauggugugggucgcugauuggauugacugcacgggcuaccugggccacgaacauccagguggcgauuaaucagguuaggcgacugaucgguaacgagaauuaccucgauuauaugacauccaugaaaagauucaagaacgaaucugacccagagggcgcucuuugguga

SEQ ID NO: 13264 - RNA, 9879 nt, Artificial Sequence
  derived and/or modified CDS sequence (opt3) from DENV-1__GU131919__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagagcaggacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacuggaagcuucaaacuggagaaggaaguggcugagacccagcacgguacgguccuugugcagaucaaguacgagggcacagacgcgccuugcaaaauuccauucuugacccaagaugaaaaggggguuacucagaacggacgccugaucacagcaaaucccauagugaccgacaaagagaagccuguaaacauugaagccgagccacccuuuggcgagucguauaucgucaucggugcuggggaaaaagcccucaagcugucuugguucaagaaaggcuccucaauuggaaagauguuugaggcaacugccagaggcgcuaggcggauggccauccuuggggauaccgcaugggacuucggaaguauugguggcguguuuacaagcguugggaaacugauacaucagaucuucggaacggcguacggcguguuguuuuccggugucucuuggaccaugaagauugggaucggcgugcuccugacuugguuaggacugaauagccgaucaacaagucuauccaugaccuguaucgcuguaggccucgugacacuguaccuugggguuaugguccaggccgauagcggaugcgugauuaacuggaaaggccgcgaauugaagugugguucugggauauucgugacuaaugagguccacaccuggacggaacaauauaaguuucaggcagacucaccgaaaagacugagugccgcuaucggaaaggccugggaggagggcguuugcgguauuaggagcgcaacacggcucgaaaacaucauguggaaacagauuuccaacgagcugaaucauaucuuacuggaaaacgacaugaaguucaccguggugguaggcgaugucgcugggauacuugcccagggaaaaaagaugauccgcccucaacccauggaguacaaauauucuuggaagucguggggcaaggcgaaaauuaucggggccgacgugcagaauacuaccuuuauuaucgauggaccaaacacaccugaaugucccgacgaucagagagcuuggaauauaugggagguugaggacuacggcuucgguauuuuuacuaccaacaucugguugaagcucagggauagcuauacacaggugugcgaccaccgucugauguccgcagccauuaaagauucaaaggcuguccacgccgacaugggguacuggaucgaaagugagaaaaaugaaacguggaagcuagcacgggcgucuuucauagaggugaagaccuguaucuggccaaaaagccauacucugugguccaacggaguucucgaaucagagaugauuauccccaagauuuauggcgguccuaucagccaacacaauuaccgaccaggcuacuucacacagaccgccgggccguggcaucugggaaaacuugaguuggauuuugaccugugcgaaggcacuacagugguagucgaugagcacugcgggaacagaggacccucuuuaaggaccacgacugugaccggcaagauaauucacgaaugguguugccgcuccuguacacucccuccacugcgguucagaggugaggacgggugcugguauggaauggagaucaggcccgugaaagaaaaggaggaaaaucuugucaagaguaugguuagcgcuggcucuggugagguggacuccuuuucacugggcuugcucuguaucaguauuaugaucgaagagguaaugcgcagccgauggucgcggaaaaugcugaugaccgggacucuagccguguuccugcuccugauuaugggacagcuuacauggaacgauuugauacgucugugcaucauggucggcgcaaaugcuugugacagaauggggaugggaaccacauacuuagcccucauggcaacuuuuaagaugaggccuauguucgccgugggccugcuuuuucgccggcugaccuccagagagguucuacuccugacgauugguuugucucugguggcuagcgucgaauuaccaaacucacucgaggaacugggggauggacuugcgaugggcaucaugauucugaaauugcucacagacuuccaaaguuaucagcugugggccacccuacugucccuuacuuuuaucaagaccacauucucucuccauuacgcauggaaaacuauggcuauggugcugagcauaguuuccuuguuuccccugugcuuaucaaccacgagccagaagacaaccuggcucccggugcugcuuggcagucugggguguaagccuuugacuauguuccucaucgccgagaauaaaauuuggggaaggcgaucuuggccacugaacgaagguaucauggccgucggcauuguauccauccuacugagcucgcuucucaagaacgaugugccccuggcugggccuuugauagcaggaggcauguuaauugccugcuauguuaucucagguucuagugcggaccugucccucgagaaagcugccgaggugagcugggaagaggaagcagagcacucuggggccagccauaauauccuggucgaagugcaggaugacggaacaaugaagauuaaagaugaggagcgcgacgauacccuuacuauacuguugaaggcuacacuacuggcaguauccggcguguacccccucucaaucccagccacccuguuugucugguauuucuggcaaaaaaagaagcagcggaguggcguucuuugggacacgccuagccccccagaaguggagagagcgguguuagaugacgggauuuacaggaucaugcagcguggacugcucggucgcucucaggucggcguggggguuuuccaagaaaacguauuucacacuauguggcaugugacccggggagcugucuugauguaccagggcaaaagacuggagccguccugggccucagugaagaaagaccucauuaguuauggugggggauggaggcugcagggcagcuggaauacaggcgaggaaguucaggugaucgcagucgagccugggaagaaccccaaaaaugugcaaaccgccccaggaacauucaagacucccgaaggugagguaggcgcuauagcccuugauuuuaagccugggaccuccggaucuccaaucgucaaccgagaaggcaaaauugugggucuguacgggaauggaguugugacgacaucgggcacuuaugucagcgcaaucgcucaggccaaggcgucacaggagggccccuugccugagauugaagacgagguguuccggaaacgcaaccuaaccaucauggaucugcacccgggguccggaaagacaagaagguaccucccagccauaguucgggaagcaauuaaacgaaaguuaagaacccugauccuugcucccacucgcguggucgccagugagauggcugaagcacugaaggguaugccuaucagguaucaaaccacagccgugaaaucugagcacacgggcaaggagauuguagaccucaugugucaugccacuuuuaccaugcguuugcugagcccagugcggguucccaauuacaacaugaucauaauggaugaagcucacuucacagacccuuccucaauugcggcaagaggguauaucucuaccagggucggaaugggcgaggccgcugccauuuuuaugacugcaacaccgcccgguagcguggaagccuucccacagaguaaugcugugauccaggaugaggaacgcgacauaccugagcgauccuggaacagcggguacgaguggauuaccgauuuucccggaaaaacggucugguucguaccaucuaucaagucaggcaaugacaucgcgaacugccucagaaaaaauggcaagcgggugauucagcuguccaggaagacuuuugauacagaauaccaaaaaaccaagaacaacgacugggacuauguugugaccacugauaucagugagaugggggccaauuuccgcgcagaccgugucauugauccuagacggugccuuaaacccgugauacuaaaggacggaccagaaaggguuauccuggcugguccgaugccugugacagucgccagcgcagcccagcgccgaggcagaauugggcggaaccauaauaaagagggagaucaguacaucuauaugggccagcccuugaacaaugacgaggaucacgcucauuggaccgaagccaagauguuacuggacaacaucaauacaccagaggguauuauacccgcgcucuucgaaccugagagggaaaagucggcagccaucgauggggaguaccgccugagaggcgaggcuaggaaaacuuuuguggaacuuaugcggcguggagaccugccaguauggcucucuuauaagguggccuccgagggcuuccaauacagcgaucgccgaugguguuuugacggggaaagaaacaaucagguuuuggaggaaaacauggaugucgagauuuggacgaaagagggagaaaggaagaaacugcggccccgcuggcuagacgcuagaaccuauucagacccucuggcacucagggaguucaaggaauuugccgcuggucggcgaagugugucuggcgaucuuauccuggagauugggaaauuaccgcagcacuugacacagagagcccaaaaugcacuggacaaccucgugaugcugcacaauuccgaacagggaggccgcgcguacaggcaugccauggaggagcuuccagauacuaucgaaacccugaugcucuuggcucugauagccgucuuaacaggugggguuacccuauucuuucugagcggccggggacucggcaagacuucaaucgggcuucugugcgugauggcaaguagcguauugcuguggauggcuuccguggagccccacuggauugccgcaucuaucauucucgaauucuuucugaugguccuucucaucccugagcccgaccgucagagaacgccacaggauaaccaacuggccuacgugguuauaggauugcuguucaugauuuuaaccguggcugcgaaugagaugggucuacuggaaacaacuaagaaagaccucggcaucgggcaugucgccguaggaaaccaccaccaugcagcuaugcuugauguggaccugcacccugccagcgccuggaccuuguaugcaguugcuacaaccauuaucacucccaugaugaggcauacaauagagaacacgaccgccaauaucucccugacugcgauugcuaaccaggccgcaauccucaugggccuggauaaggguuggccaauuucaaaaauggacaucggggugccucuuuuagcccugggcuguuacucucaggucaauccgcucacauugaccgcugcagugcugaugcuagucgcccacuaugcgauaauuggacccggccugcaagcuaaggccacccgcgaagcacagaaacggacagccgcugggaucaugaagaacccaacuguggauggaaucguugccauugaccucgauccugugguauacgacgcaaaguuugagaaacagcuuggccagaucaugcuguugauacugugcacgagucaaauucuccugaugcgaaccacaugggcuuuaugugaaucgaucacucuugccaccgguccccugacaacccucugggaggggagcccaggaaaguucuggaauacuacgauugcgguguccauggccaacaucuuuagaggcucuuaucuagcaggugcuggccuggccuucucauugaugaaaagccuggggggaggcaggcgcgggacaggagcacagggcgagacccucggugaaaaguggaaacggcagcuuaaucagcuguccaagagugaguucaacacuuacaagagaucugggauaauggaagucgaccguagcgaggcuaaagaaggauugaagaggggcgagaccacaaaacaugccguuucacgggguacugccaagcugcgcugguuuguggagcgaaaucucgucaaaccugaaggcaaggugaucgauuuagggugcggaagaggcgggugguccuauuacugugcgggacugaagaaaguaaccgaggugaagggcuacacaaaaggugggcccggacacgaagagccgauuccaauggcuacguauggcuggaaccuuguuaagcugcacaguggcaaagacguguucuuuaucccucccgaaaagugcgauacccuacucugugacauuggggagagcucuccaaaucccacuaucgaggaaggaaggacacugcgggucuugaaaaugguggagccuuggcugcgcgguaaccaauucugcauuaagauccucaauccguacaugcccuccgucguggaaacccuugagcagaugcagagaaagcauggcgggaugcugguuaggaacccauuaucacgaaauagcacucacgagauguauuggguaucguguggaacaggcaacauagugucugcagucaauaugaccagucggaugcuguugaaccguuuuacgauggcccauagaaaaccuaccuacgaacgcgauguggaccucggugcugggacaaggcacguugccguggagcccgaagucgcaaaccuggauauuaucggacagcggaucgagaauauuaagcacgaacauaaauccacuuggcacuaugacgaggauaacccuuacaagaccugggccuaucauggcagcuacgaggugaaaccaucaggcuccgcuucuagcaugguaaauggggugguuaagcuacuuacaaagcccugggacgucauaccuauggugacucaaaucgcgaugaccgauacaaccccauucggacagcagagaguguuuaaagaaaaggucgacacucgcacgcccaaagccaagagggguacagcacaaauuauggagguuaccgcuaaauggcuguggggcuuccucagucgaaacaagaagccgcggaucugcacuagagaagaguuuaccaggaaagugcgcuccaaugccgcaauuggggccguauucguggacgaaaaccaguggaauagcgcuaaggaggccgucgaggaugaacguuuuugggaccuggugcaccgggagagagaauugcauaaacagggaaagugcgcgacauguguuuacaacaugaugggcaaaagggagaagaagcugggugaauucgggaaagcaaagggaucucgcgccaucugguauauguggcucggcgcucgauuucuugaguucgaggcccugggcuucaugaaugaagaucacugguuuucacgggagaacaguuuauccgggguggaaggagagggucugcacaaauugggcuacauacucagagacaucagcaagauuccugggggaaauauguaugcagaugacacggcuggcugggauaccaggaucacugaggacgaucugcagaacgaagcccgcauuacagacaucauggagccagaacaugcucuacuugccaaaucuauauucaagcugaccuaccaaaauaaagucgugagaguacagcggcccgcaaagaacgguacuguuauggaugugauuucgaggcgugaccagcgagggucaggacaggucggcacauauggccucaauaccuuuacaaacauggaggcgcaacugauccgccagauggaaagcgaggggaucuucuccccuagugaguuggaaacuccaaacuuagccgagagagugcuggauuggcucgaaaaguacggaguggagcggcuuaaaaggauggcuauuucuggugacgacugcgucguuaagcccauagaugaccgcuuugccaccgcacugacggcucuaaaugauaugggcaaagugagaaaggacaucccgcagugggaaccuagcaaaggguggaacgauuggcagcaaguacccuucuguucccaccauuuucaccagcugauuaugaaggacggacgggagaucguggucccaugcaggaaucaggaugagcucgugggccgagcccguguuucacagggugcaggguggaguuugagagaaaccgccugucugggaaagucuuaugcgcaaauguggcagcuuauguacuuccaccgccgggaccugaggcucgcugccaacgcaauuugcagcgccgugccugucgauuggauccccacauccagaacuaccuggucaauacaugcucaccaucaguggaugacaacugaggacauguuaagcguguggaaucgcguauggaucgaagagaacccauggauggaagauaaaacccacauuucuuccuggggcgacguucccuaccugggcaagcgggaggaccaauggugugggaguuugaucggacugacggccagggcaacaugggcuaccaauauucagguggccaucaaccagguccgaagacucauugguaaugagaacuaucuugauuacaugacuagcaugaaacgguuuaagaaugaaucggacccugagggcgcgcugugguga

SEQ ID NO: 13265 - RNA, 9879 nt, Artificial Sequence
  derived and/or modified CDS sequence (opt3) from DENV-1__GU131920__SS-prME
uccgugaccaugcugcucaugcuuaugcccacagcacuggcuuuccacuugacuacgagaggcggggagccucauaugaucgucuccaagcaggaaaggggaaaaucuuuacuguuuaagaccucagccgguguuaacaugugcacauuaauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcacuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacuggaucguucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacagagagaaaccuguaaacauugaagccgagccacccuuuggcgagucuuauaucgucaucggugcuggggaaaaggcccugaaacucuccugguucaagaagggcucaaguauuggaaaaauguuugaggcaacugccaggggcgcucggcgaauggccauccugggggauaccgcaugggacuucggaagcauugguggcguguuuacauccguugggaaacuugugcaucagauauucggaacggcguacggcguccuguuuucuggugugagcuggaccaugaaaaucgggauuggcguauugcucacuuggcugggauuaaauucacgcaguacaucccugagcaugaccuguaucgcugugggccuaguuacacucuaccugggggucauggugcaggccgauucuggaugcgugaucaacuggaagggcagagaacuuaaaugugguucagggauuuucgucacuaaugagguucacaccuggacggaacaauauaaguuucaggcagacaguccgaagagguugagcgccgcuauaggaaaagccugggaggagggcgugugcgguauccgguccgcaacacgccuggaaaacauuauguggaagcagaucucuaacgagcucaaucauauucuguuagaaaacgacaugaaauucaccgugguagucggcgauguggcugggauccuggcccagggaaagaaaaugauaagaccucaacccauggaguacaaguauucguggaaaagcuggggcaaggcgaagaucauuggggccgacguucagaauacuaccuuuaucauugauggaccaaacacaccugaaugucccgacgaucagagggcuuggaauaucugggagguggaggacuacggcuucgguauauuuacuaccaacauuuggcuuaaauugcgugauuccuauacacaggucugcgaccaccggcucaugucagcagccaucaaggauaguaaagcugugcacgccgacaugggguacuggauugaaucugagaagaaugaaacguggaaacuggcacgagcgagcuucaucgagguuaagaccuguauauggccaaagucccauacucuauggucaaacggagugcuggaaagcgagaugaucauucccaaaaucuauggcgguccuauuucucaacacaauuacagaccaggcuacuucacacagaccgccgggccguggcaucucggaaagcuggagcuugauuuugacuugugcgaaggcacuacaguagucguggaugagcacugcgggaacaggggacccucccugcgcaccacgacugugaccggcaaaaucauacacgaaugguguugccggaguuguacauuaccuccacucagauucaggggugaggacgggugcugguauggaauggagauucgccccgucaaggaaaaagaggaaaaucugguuaagagcauggugucugcuggcuccggugagguagacucauuuagucuuggccuguuguguaucagcaucaugauugaagaggugaugcgaucgcgguggucccguaagaugcucaugaccgggacucuggccgucuuccuacugcucaucaugggacagcugacauggaacgaucuuauuagauugugcauaauggugggcgcaaaugcuucugacaggauggggaugggaaccacauaccuggccuuaauggcaacuuuuaaaaugcgcccuauguucgccguuggccuccuguuucggagacuuaccagcagggaggugcugcuacucacgaucggucugucauuggucgcuaguguggaacugccaaacuccuuagaggaacucggggauggacuggcgaugggcauuaugauccuuaagcuguugacagacuuccaaucucaucagcucugggccacccugcuaagccugacuuuuauuaaaaccacauucucccuucacuaugcauggaagacuauggcuaugguucucucaaucgugagccuguuucccuugugucugaguaccacgucucagaaaacaaccugguuaccgguccuccugggcucccuugggugcaagccucugacuauguucuugauagccgagaauaagaucuggggacgacgcagcuggccacucaacgaagguauuauggccguaggcaucgugucgauucugcuaucaucucugcuuaaaaacgauguuccccucgcugggccucugaucgcaggaggcauguugauagccuguuacgugauuagugguuccagcgcggacuuaucucuggagaaggcugccgaggucagcugggaagaggaagcagagcauuccggggccucacacaauauccucguggaaguacaggaugacggaacaaugaaaaucaaggaugaggagcgggacgauacccugacuauucuucugaaagcuacauugcuagcagugaguggcgucuauccccugagcauaccagccacccucuuuguuugguacuucuggcaaaagaaaaagcagagaucuggcgugcugugggacacgccuucacccccagaaguggagagggcgguccuugaugacgggaucuaucguauuaugcagcgcggauuacugggucggagccaggugggcguugggguauuccaagaaaacguguuucauacuauguggcacgucaccagaggagcugugcucauguaccagggcaagagguuggagccgaguugggccagcguuaaaaaggaccugaucuccuacggugggggauggcgacuccagggcucuuggaauacaggcgaggaagugcaggucauugcaguggagccugggaaaaaccccaagaauguacaaaccgccccaggaacauucaaaacucccgaaggugaggucggcgcuaucgcccuggauuuuaagccugggaccucgggaagcccaauagugaaccgggaaggcaagaucguuggucuuuaugggaauggaguggucacgacaucaggcacuuacguguccgcaauugcucaggccaaagcgagucaggagggcccccugccugagaucgaagacgagguuuuccgcaagagaaacuugaccauuauggaucuacacccggggucuggaaaaacaaggcgguaucugccagccaucgugcgagaagcaauaaagagacgccucaggaccuuaauucuggcucccacucgugucguggccagcgagauggcugaagcacuuaaagguaugccuauccgguaccaaaccacagccguaaaguccgagcauacgggcaaggagaucguggaccugaugugccacgccacuuuuaccaugagacucuugucaccaguuaggguccccaauuauaacaugauuaucauggaugaagcucauuucacagacccuucuagcauagcggcacgcggguacauuaguacccgagugggaaugggcgaggccgcugccaucuuuaugacugcaacaccgcccgguuccguggaagccuucccacagagcaaugcugucauucaggaugaggaaagagacaucccugagcggucuuggaacucaggguaugaguggauaaccgauuuucccggaaaaacgguaugguucgugccauccauuaagaguggcaaugacaucgcgaacugucugaggaaaaauggcaagcgcguuauccagcucagccguaaaacuuuugauacagaauaccaaaagaccaagaacaacgacugggacuacguggucaccacugauauuucggagaugggggccaauuucagagcagaccgggugaucgauccuaggcgcugccugaaacccguuauucuuaaggacggaccagaacgagugauacuagcugguccgaugccugucacaguggccucugcagcccagagacggggcaggaucgggcgcaaccacaauaaagagggagaucaguauauuuacaugggccagccccugaacaaugacgaggaucaugcucacuggaccgaagccaagauguuguuagacaacaucaauacaccagaggguaucauucccgcgcuguucgaaccugagagagaaaaauccgcagccauagauggggaguauaggcuccggggcgaggcucguaagacuuuuguagaacugaugcgccgaggagaccuuccaguguggcugagcuacaagguugccucagagggcuuccaauauagugauagaagguggugcuuugacggggaacggaacaaucagguccucgaggaaaacauggauguggagaucuggacgaaagagggagaacgcaagaaauugagacccagguggcuggacgcucggaccuacucugacccucuagcacugcgagaguucaaggaauuugccgcugguagacgcuccgugagcggcgaucucauucuugagaucgggaaacugccgcagcacuuaacacagagggcccaaaaugcauuggacaaccuggucaugcuccauaauucagaacagggaggccgggcguaucgucacgccauggaggagcugccagauacuauugaaacccuuaugcugcucgcuuugaucgccguucugacagguggggugaccuuauucuuucuaaguggcagaggacugggcaagacuagcauagggcuccuuuguguaauggcauccucugugcuguuguggauggcuagcgucgagccccauuggaucgccgcauccauuauccuggaguucuuucucauggugcugcuuauuccugagcccgacaggcagcgcacgccacaggauaaccaacucgccuacguugugaucggacuguuguucaugauacugaccgucgcugcgaaugagauggguuuacuagaaacaacuaaaaaggaccugggcauugggcacguagccgugggaaaccaccaucacgcagcuaugcucgauguugaccuucauccugccucagccuggacccuguacgcaguggcuacaaccaucauuacucccaugaugcggcacacaaucgagaacacgaccgccaauauaucuuugacugcgaucgcuaaccaggccgcaauucugaugggccucgauaaggguuggccaaucaguaaaauggacauuggggucccucugcuugccuuaggcugcuauagccaggugaauccgcugacacucaccgcugcagucuugaugcugguggcccauuacgcgaucauaggacccggccuacaagcuaaggccacccgagaagcacagaaaagaacagccgcugggauuaugaagaacccaacuguugauggaaucguggccaucgaccuggauccuguaguguaugacgcaaaauuugagaagcagcucggccagauuaugcuucugaucuuguguacgagccaaauacugcucaugaggaccacaugggcucugugcgaauccauuacuuuagccaccgguccccuuacaacccugugggaggggucuccaggaaaguucuggaauacuacgaucgcggucucaauggccaacauuuuucgcggcagcuaccucgccggugcuggccuagccuucucccugaugaaaagucuagggggaggccggagagggacaggagcacagggcgagacccugggugaaaaguggaaacgucagcucaaucagcuuucuaagagcgaguucaacacuuauaaaaggucagggaucauggaaguugaccgguccgaggcuaaggaaggacugaagcgcggcgagaccacaaaacacgccgugagucgagguacugccaaguugagaugguuugucgagaggaaucuggugaaaccugaaggcaagguaauagaucucggguguggacggggcggguggagcuacuauugcgcgggacuaaagaaggugaccgagguuaagggcuacacaaaaggugggcccggacacgaagaaccgaucccaauggcuacguacggcuggaaccuggugaaacuucauucuggcaaagacgucuucuuuauuccucccgaaaagugugauacccugcuaugcgacaucggggaguccucaccaaaucccacuauugaggaaggacgcacacucagagugcugaaaauggucgagccuugguugagggguaaccaauucuguaucaagauucugaauccguauaugcccagcgugguugaaacccucgagcagaugcagcgaaaacacggcgggaugcuuguacggaacccacugucgcguaauucuacucaugagauguacugggugaguugcggaacaggcaacaucgucuccgcagugaauaugaccagcagaauguuacugaaccgcuuuacgauggcccacaggaagccuaccuaugaacgggauguugacuugggugcugggacaagacacguggccgucgagcccgaaguggcaaaccucgauauaauuggacagcgcaucgagaauaucaagcaugaacacaaaucaacuuggcauuacgacgaggauaacccuuauaagaccugggccuaccacggcuccuaugagguaaaaccaucuggcagcgcuaguuccauggugaaugggguugucaagcugcuaacaaaacccugggacgugauuccuauggugacucaaauagcgaugaccgauacaaccccauucggacagcagagggucuuuaaggaaaagguugacacucgaacgcccaaagccaagcgggguacagcacaaaucauggaggugaccgcuaaauggcuuuggggcuuccugagcagaaacaagaaaccgaggauuuguacucgcgaagaguuuacccguaagguacggucuaaugccgcaaucggggccguguucgucgacgaaaaccaguggaacucagcuaaggaggccguggaggaugaaagauuuugggaccucguucauaaagagagggaacugcacaagcagggaaaaugcgcgacaugcguguacaacaugaugggcaagcgcgagaaaaaguugggugaguucgggaaggcaaaaggaagucgagccauuugguacauguggcugggcgcucgguuucucgaguucgaggcccuuggcuucaugaaugaagaucacugguuuuccagagagaacagccugucuggggucgaaggagaggguuuacauaagcugggcuauaucuugagggacauaucgaaaaucccugggggaaauauguacgcagaugacacggcuggcugggauacccgcauuacugaggacgaucuccagaacgaagccagaaucacagacauuauggagccagaacacgcucugcuagccaagucaaucuucaaacuuaccuaucaaaauaaggugguacggguucagaggcccgccaagaaugguacugugauggaugucauaagccgucgagaccagcgcggguccggacaggugggcacauacggccugaauaccuuuacaaacauggaggcgcaacucauuagacagauggaaagugaggggaucuucucuccuagcgagcuggaaacuccaaacuuggccgagcggguguuagauuggcuggaaaaguauggagucgagaggcucaagcgcauggcuaucuccggugacgacuguguugugaaacccauugaugacagauuugccaccgcacuuacggcucugaaugauaugggcaagguacggaaagacauaccgcagugggaaccuucaaagggguggaacgauuggcagcaagugcccuucugcagucaucacuuucaccagcuaaucaugaaagacggaagggagauugucgugccaugucgaaaucaggaugagcugguuggccgugccagagugucucagggugcaggguggagccuccgcgaaaccgccugcuugggaaaguccuacgcgcaaauguggcagcugauguauuuccaucggagggaccuuagacuggcugccaacgcaaucuguucagccgucccuguggauuggauucccacaagccgcacuaccuggucuauccacgcucaucaccaguggaugacaacugaggacaugcucuccguauggaaucggguuuggauagaagagaacccauggauggaagauaagacccauaucaguagcuggggcgacgugcccuacuuaggcaaaagggaggaccaauggugcgggucgcugauuggauugacggcccgagcaacaugggcuaccaauauccaggucgccauuaaccaggugagacggcugaucgguaaugagaacuaccucgauuauaugacuuccaugaagagguuuaaaaaugaaucugacccugagggcgcgcuuugguga

SEQ ID NO: 13266 - RNA, 9879 nt, Artificial Sequence
  derived and/or modified CDS sequence (opt3) from DENV-1__GU131921__SS-prME
uccgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaauaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauggcacuguuucuggcccaugcuauuggcacaucgaucacccagaagggcauuaucuucauacucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaauugcucaagacagaggugaccaacccugccauccugaggaaacuuugcauugaagcuaagaucucuaauacgaccacagauagccgguguccaacucaaggagaggccacccugguggaagaacaggacgcaaacuucgucugccgccgaacauuuguugauagaggcugggguaauggguguggauuguucggcaaaggcucccucauaacuugcgcuaaguuuaagugcgugaccaaacuggaggggaagauuguacaguacgaaaacuuaaaauauucagugaucgucacagugcacaccggagaccagcaucaaguugguaaugagaguacugaacacggcacgacagccaccauuacuccccaggcgccuaugaccgagauccagcugacagacuacggggcccucacccuugauuguagcccaaggacuggacuggacuucaacgaaaugguguugcuaacaaugaaggagaaaucuuggcugguccauaagcagugguuucucgaucugccgcuucccuggacguccggcgcaucaaccagccaagagacuuggaaucggcaggaccuguuggugacauucaaaaccgcucacgccaagaagcaggaaguaguugugcucgguagucaagagggggcuaugcacacagcccugacuggcgcaaccgaaauccagacgucuggaaccacaacuauuuuugccggccauuuaaaaugccgucugaagauggauaaacuaacccucaaggggauguccuaugucauguguacagguagcuucaaacuggagaaggaaguggcugagacucagcacggaaccguccuugugcagauaaaguacgagggcacggacgcgccuugcaaaaucccauucucgacacaagaugaaaaggggguuacccagaacggacgcuugauuacugcaaaucccaucgugacagacaaagagaagccuguaaacauagaagccgagccacccuuuggcgagucuuauauugucaucggugcuggggaaaaagcccugaagcucuccugguucaagaaaggcucaaguaucggaaagauguuugaggcaaccgccagaggcgcuaggcggauggccauucugggggauacugcaugggacuucggaagcaucgguggcguguuuaccuccguugggaaacuugugcaucagauuuucggagcggcuuacggcguccuguuuucuggugugagcuggacaaugaagauagggaucggcguauugcucacguggcugggauuaaauucacgaaguaccucccugagcaugacuuguauugccgugggccuaguuacacucuaccugggggucauggugcaggcagauucuggaugcgugaucaacuggaaaggccgcgaacuuaagugugguucagggaucuucgucaccaaugagguucacacauggacugaacaauauaaguuucaggccgacaguccgaaaagauugagcgcugccauuggaaaggcaugggaggagggcgugugcgguauaagguccgcuacccggcuggaaaacaucauguggaaacagauuucuaacgagcucaaucauauccuguuagaaaacgacaugaaguucacggugguagucggcgauguggccgggauucuggcgcagggcaaaaagaugauccgcccucaacccauggaguacaaauauucguggaaaagcuggggcaaggccaaaauaaucggggcugacguucagaauacaaccuuuauuaucgauggaccaaacacuccugaaugucccgacgaucagagagcauggaauauuugggagguggaggacuacggcuucgguaucuuuaccacaaacauauggcuuaaguugagggauuccuauacucaggucugcgaccaccgucucaugucagccgcuauuaaagauaguaaggccgugcacgcagacaugggguacuggaucgaaucugagaaaaaugaaaccuggaagcuggcgcgggccagcuucauugagguuaagacauguaucuggccaaaaucccauacgcuauggucaaacggagugcuggaaagcgagaugauaauccccaagauuuauggcgguccuaucucucaacacaauuaccgaccaggcuacuucacccagacugcugggccguggcaucucggaaaacuggagcuugauuuugacuugugcgaaggcacaaccguagucguggaugagcacugcgggaacagaggacccucccugaggacuacaaccgugacgggcaagauuauccacgaaugguguugccgcaguuguacuuuaccuccacuccgguucagaggugaggacgggugcugguauggaauggagauaaggcccgucaaagaaaaggaggaaaaucugguuaagagcauggugucugccggcuccggugagguagacucauuuagucuuggccuguuguguauuagcaucaugaucgaagaggugaugcgcucgcgauggucccggaaaaugcucaugaccgggacacuggcagucuuccuacugcucauuaugggacagcugaccuggaacgaucuuauccguuugugcauuauggugggcgcuaaugccucugacagaauggggaugggaacuacauaccuggcauuaauggccaccuuuaagaugaggccuauguucgcuguuggccuccuguuucgccggcuuacaagcagagaggugcugcuacucacuauaggucugucauuggucgcgaguguggaacugccaaacuccuuagaggaacucggggauggacuggccaugggcaucaugauucuuaaacuguugaccgacuuccaaucucaucagcucugggcaacgcugcuaagccugacauuuaucaagaccacuuucucccuucacuaugcuuggaaaaccauggccaugguucucucaauugugagccuguuucccuugugucugaguacaacuucucagaagaccacgugguuaccgguccuccugggcucccuugggugcaagccucugacaauguucuugaucgccgagaauaaaauauggggaaggcgaagcuggccacucaacgaagguaucauggcuguaggcauugugucgauccugcuaucaucucugcuuaagaacgauguuccccucgcagggccucugauugccggaggcauguugaucgcguguuacgugauaagugguuccagcgcugacuuaucucuggagaaagccgcagaggucagcugggaagaggaagccgagcauuccggggcuucacacaauauucucguggaaguacaggaugacggaaccaugaagaucaaagaugaggagcgcgacgauacucugacaauccuucugaaggcaaccuugcuagccgugaguggcgucuauccccugagcauuccagcgacucucuuuguuugguacuucuggcagaaaaagaagcagcggucuggcgugcugugggacacaccuucacccccagaaguggagaaagcuguccuugaugacgggauauauagaaucaugcagaggggauuacugggucguagccaggugggcguugggguauuccaagaaaacguguuucauaccauguggcacgucacgcgcggagccgugcucauguaccagggcaagcgguuggagccgaguugggcaagcguuaaaaaggaccugauuuccuacggugggggauggagacuccagggcucuuggaauacuggcgaggaagugcaggucaucgccguggagccugggaaaaaccccaagaauguacaaaccgcuccaggaacauucaagacccccgaaggugaggucggcgccauugcacuggauuuuaaaccugggacaucgggaagcccaaucgugaacagggaaggcaagauaguuggucuuuaugggaauggaguggucacuaccucaggcacguacguguccgcuaucgcccaggcgaaagccagucaggagggcccccugccugagauugaagacgagguuuuccgaaagcggaacuugacaaucauggaucuacacccggggucuggaaaaacucgcagauaucugccagcaauugugagggaagcuaucaagcggaagcuccgaaccuuaauacuggcccccacaagagucguggcuagcgagauggcagaagcccuuaaagguaugccuauucgcuaccaaaccacugccguaaaguccgagcauaccggcaaagagaucguggaccugaugugccacgcuacauuuacgaugaggcucuugucaccaguucguguccccaauuauaacaugaucauuauggaugaagcgcauuucacugacccuucuagcaucgcagcccggggguacauaaguaccagagugggaaugggcgaggcugccgcaauuuuuaugacagccaccccgcccgguuccguggaggcuuucccacagagcaaugcggucauccaggaugaggaaagggacauuccugagcgcucuuggaacucaggguaugaguggaucacugauuuucccggaaagacaguaugguucgugccauccauaaaaaguggcaaugacauugccaacugucugcgaaagaauggcaagagaguuauccagcucagccggaaaaccuuugauacggaauaccaaaagacuaaaaacaacgacugggacuacguggucacaaccgauaucucggagaugggggcaaauuucagggcugaccgcgugauugauccucguagaugccugaagcccguuauccuuaaagacggaccagaacgggugauucuagccgguccgaugccugucaccguggcaucugccgcucagaggcgcggccgaauagggagaaaccacaauaaggagggagaucaguauaucuacaugggccagccccugaacaaugacgaggaucaugcccacuggacugaagcgaagauguuguuagacaacauuaauacaccagaggguaucauccccgcacuguucgaaccugagcgggaaaaauccgccgcuauugauggggaguauaggcuccgcggcgaggccagaaagaccuuuguagaacugaugaggcggggagaccuuccaguguggcugagcuacaaaguugcuucagagggcuuccaauauagugaucgucgcuggugcuuugacggggaacgaaacaaucagguccucgaggaaaacauggauguggagauauggacaaaggagggagaaaggaaaaaguugaggccccgguggcuggacgcacgcacuuacucugacccucuagcccugagagaguucaaagaauuugcugccgguaggcgguccgugagcggcgaucucauccuugagauugggaagcugccgcagcacuuaacgcagcgagcacaaaaugcguuggacaaccuggucaugcuccauaauucagaacagggaggcagagccuaucgccacgcuauggaggagcugccagauaccaucgaaacacuuaugcugcucgccuugauugcaguucugacugguggggugaccuuauucuuucuaaguggcaggggacugggcaagacaagcaucgggcuccuuuguguaauggcuuccucugugcuguuguggauggccagcgucgagccccauuggauagcagccuccaucauucuggaguucuuucucauggugcugcuuaucccugagcccgaccggcagcguaccccacaggauaaccaacucgcuuacguugugauuggacuguuguucaugauccugacugucgcggccaaugagauggguuuacuagaaacgaccaaaaaggaccugggcauagggcacguagcagugggaaaccaccaucacgcugccaugcucgauguugaccuucauccugccucagcauggacacuguacgcuguggccacuaccauuaucacacccaugaugagacacaccauugagaacacuacagcgaauaucucuuugacggcuauagccaaccaggcagccauccugaugggccucgauaaagguuggccaauuaguaagauggacaucggggucccucugcuugcuuuaggcugcuauucgcaagugaauccgcugacccucacugcagccgucuugaugcugguggcgcauuacgcuauuaucggacccggccuacaagccaaagcaacaagggaagcccagaagcgcaccgcugccgggauaaugaagaacccaaccguugauggaauuguggcaaucgaccuggauccuguaguguaugacgcuaaauuugagaagcagcucggccagaucaugcuucugauuuuguguacaagccaaauccugcucaugcggacuacgugggcccugugcgaauccauaaccuuagcgacagguccccuuacuacccugugggaggggucuccaggaaaauucuggaauacaaccauugccgucucaauggcaaacaucuuucgaggcagcuaccucgcuggugccggccuagcauucucccugaugaagagucuagggggaggcagaagggggacuggagcucagggcgagacgcugggugaaaaauggaagcgccagcucaaucagcuuucuaagagcgaguucaacacauauaaacggucagggauuauggaaguugacagauccgaggccaaggaaggacugaaacguggcgagaccacuaagcacgccgugaguagggguaccgcgaaauugcggugguuugucgagcgcaaucuggugaagccugaaggcaagguaaucgaucucggguguggacgaggcggguggagcuacuauugcgcuggacuaaagaaggugacagagguuaaaggcuacacuaagggugggcccggacacgaagaaccgauaccaauggcaaccuacggcuggaaccuggugaaacuucauucuggcaaggacgucuucuuuaucccucccgaaaaaugugauacacugcuaugcgacauuggggaguccucaccaaaucccacgaucgaggaaggaagaacccucagggugcugaagauggucgagccuugguugcgggguaaccaauucuguauuaagauccugaauccguauaugcccagcgugguugaaacucucgagcagaugcagcgcaaacacggcgggaugcuuguaagaaacccacugucgagaaauucuacacaugagauguacugggugaguugcggaaccggcaacauugucuccgccgugaauaugacuagccgaauguuacugaaccgguuuacaauggcucaccguaagccuaccuaugaaagagauguugacuugggugccgggacgcgccacguggcagucgagcccgaaguggccaaccucgauaucauaggacagaggauugagaauaucaaacaugaacacaagucaaccuggcauuacgacgaggauaacccuuauaaaacaugggcuuaccacggcuccuaugagguaaagccaucuggcagcgcgaguuccauggugaaugggguugucaagcugcuaacuaaacccugggacgugaucccuauggugacccaaauugccaugacagauacuaccccauucggacagcagcgggucuuuaaggaaaaaguugacacaagaacccccaaggcaaaacgcgguacugcucaaauaauggaggugacggccaaguggcuuuggggcuuccugagcaggaacaagaaaccgcgaaucuguacacgggaagaguuuaccagaaagguaaggucuaaugcagccauuggggcuguguucgucgacgaaaaccaguggaacucagccaaagaggcgguggaggaugaacgcuuuugggaccucguucaucgugagcgggaacugcacaagcagggaaaaugcgcaacuugcguguacaacaugaugggcaagagagagaagaaauugggugaguucgggaaggccaaaggaaguagggcuaucugguacauguggcugggcgcccgcuuucucgaguucgaggcacuuggcuucaugaaugaagaucacugguuuucccgagagaacagccugucuggggucgaaggagaggguuuacauaagcugggcuauauuuugcgggacaucucgaaaauaccugggggaaauauguacgcugaugacaccgccggcugggauacaagaaucacggaggacgaucuccagaacgaagcuaggauuaccgacaucauggagccagaacacgcccugcuagcaaagucaauuuucaaacuuacuuaucaaaauaaggugguacgcguucagagacccgcgaagaacgguacagugauggaugucaucagccggagggaccagcguggguccggacaggugggcaccuacggccugaauacuuuuacaaacauggaggcccaacucauacgacagauggaaagugaggggauuuucucuccuagcgagcuggaaaccccaaacuuggcugagcgcguguuagauuggcuggaaaaauauggagucgagagacucaagcggauggccaucuccggugacgacuguguugugaaacccaucgaugacagguuugcaacagcucuuacugcccugaaugauaugggcaagguacgcaaagacauuccgcagugggaaccuucaaagggguggaacgauuggcagcaagugcccuucugcagucaucacuuucaccagcuaauaaugaaggacggaagagagaucgucgugccaugucggaaucaggaugagcugguuggcagggcacgagugucucagggugccggguggagccuccgugaaaccgcgugcuugggaaaauccuacgcucaaauguggcagcugauguauuuccauagacgcgaccuucggcuggccgcaaacgccauuuguucagcugucccuguggauuggauccccacgagcaggaccacauggucuauucacgcccaucaccaguggaugacuaccgaggacaugcucuccguauggaauagaguuuggaucgaagagaacccauggauggaagauaagacacauauaaguagcuggggcgacgugcccuacuuaggcaaacgcgaggaccaauggugcgggucgcugaucggauugacugcacgggcuaccugggccacgaauauucaggucgcgaucaaccaggugaggcgacugauugguaaugagaacuaccucgauuauaugacauccaugaagagauuuaaaaaugaaucugacccugagggcgcucuuugguga

SEQ ID NO: 13267 - RNA, 9879 nt, Artificial Sequence
  derived and/or modified CDS sequence (opt3) from DENV-1__GQ868635__SS-prME
uccgugacaaugcugcucaugcuuaugcccacagcacuggcuuuccacuugacuacgagaggaggggaaccucauaugaucgucuccaagcaggaaaggggaaaaucuuuacuguuuaagacaucagccgguguuaacaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauggcacuguuucuggcccaugcuauuggcacaucgaucacccagaagggcauuaucuucauacucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaauugcucaagacagaggugaccaacccugccauccugaggaaacuuugcauugaagcuaagaucucuaauacgaccacagauagccgguguccaacucaaggagaggccacccugguggaagaacaggacgcaaacuucgucugccgccgaacauuuguugauagaggcugggguaauggguguggauuguucggcaaaggcucccucauaacuugcgcuaaguuuaagugcgugaccaaacuggaggggaagauuguacaguacgaaaacuuaaaauauucagugaucgucacagugcacaccggagaccagcaucaaguugguaaugagaguacugaacacggcacgacagccaccauuacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggagcggcuuacggcguccuguuuucuggugugagcuggacgaugaagauagggaucggcguauugcucaccuggcugggauuaaauucacgaaguacuucccugagcaugacauguauugccgugggccuaguuacccucuaccugggggucauggugcaggcagauucuggaugcgugaucaacuggaaaggccgcgaacuuaagugugguucagggaucuucgucacaaaugagguucacacuuggaccgaacaauauaaguuucaggccgacaguccgaaaagauugagcgcugccauuggaaaggcaugggaggagggcgugugcgguauaagguccgcuacgcggcuggaaaacaucauguggaaacagauuucuaacgagcucaaucauauccuguuagaaaacgacaugaaguucacagugguagucggcgauguggccgggauucuggcgcagggcaaaaagaugauccgcccucaacccauggaguacaaauauucguggaaaagcuggggcaaggccaaaauaaucggggcugacguucagaauaccacuuuuauuaucgauggaccaaacaccccugaaugucccgacgaucagagagcauggaauauuugggagguggaggacuacggcuucgguaucuuuacaacuaacauauggcuuaaguugagggauuccuauacccaggucugcgaccaccgucucaugucagccgcuauuaaagauaguaaggccgugcacgcagacaugggguacuggaucgaaucugagaaaaaugaaacauggaagcuggcgcgggccagcuucauugagguuaagacguguaucuggccaaaaucccauacccuauggucaaacggagugcuggaaagcgagaugauaauccccaagauuuauggcgguccuaucucucaacacaauuaccgaccaggcuacuucacucagacagcugggccguggcaucucggaaaacuggagcuugauuuugacuugugcgaaggcaccacuguagucguggaugagcacugcgggaacagaggacccucccugaggacaaccacggugacuggcaagauuauccacgaaugguguugccgcaguuguaccuuaccuccacuccgguucagaggugaggacgggugcugguauggaauggagauaaggcccgucaaagaaaaggaggaaaaucugguuaagagcauggugucugccggcuccggugagguagacucauuuagucuuggccuguuguguauuagcaucaugaucgaagaggugaugcgcucgcgauggucccggaaaaugcucaugacagggacccuggcagucuuccuacugcucauuaugggacagcugacuuggaacgaucuuauccguuugugcauuauggugggcgcuaaugccucugacagaauggggaugggaacaaccuaccuggcauuaauggccacauuuaagaugaggccuauguucgcuguuggccuccuguuucgccggcuuacuagcagagaggugcugcuacucaccauaggucugucauuggucgcgaguguggaacugccaaacuccuuagaggaacucggggauggacuggccaugggcaucaugauucuuaaacuguugacggacuuccaaucucaucagcucugggcaacacugcuaagccugaccuuuaucaagacuaccuucucccuucacuaugcuuggaaaacaauggccaugguucucucaauugugagccuguuucccuugugucugaguacuaccucucagaagacgacaugguuaccgguccuccugggcucccuugggugcaagccucugaccauguucuugaucgccgagaauaaaauauggggaaggcgaagcuggccacucaacgaagguaucauggcuguaggcauugugucgauccugcuaucaucucugcuuaagaacgauguuccccucgcagggccucugauugccggaggcauguugaucgcguguuacgugauaagugguuccagcgcugacuuaucucuggagaaagccgcagaggucagcugggaagaggaagccgagcauuccggggcuucacacaauauucucguggaaguacaggaugacggaacuaugaagaucaaagaugaggagcgcgacgauacacugaccauccuucugaaggcaacuuugcuagccgugaguggcgucuauccccugagcauuccagcgacacucuuuguuugguacuucuggcagaaaaagaagcagcggucuggcgugcugugggacaccccuucacccccagaaguggagaaagcuguccuugaugacgggauauauagaaucaugcagaggggauuacugggucguagccaggugggcguugggguauuccaagaaaacguguuucauacgauguggcacgucacucgcggagccgugcucauguaccagggcaagcgguuggagccgaguugggcaagcguuaaaaaggaccugauuuccuacggugggggauggagacuccagggcucuuggaauaccggcgaggaagugcaggucaucgccguggagccugggaaaaaccccaagaauguacaaacagcuccaggaaccuucaagacacccgaaggugaggucggcgccauugcacuggauuuuaaaccugggacuucgggaagcccaaucgugaacagggaaggcaagauaguuggucuuuaugggaauggaguggucaccacgucaggcacauacguguccgcuaucgcccaggcgaaagccagucaggagggcccccugccugagauugaagacgagguuuuccgaaagcggaacuugacuaucauggaucuacacccggggucuggaaaaacccgcagauaucugccagcaauugugagggaagcuaucaagcggaagcuccgaacauuaauacuggcccccaccagagucguggcuagcgagauggcagaagcccuuaaagguaugccuauucgcuaccaaacuaccgccguaaaguccgagcauacaggcaaagagaucguggaccugaugugccacgcuacguuuacuaugaggcucuugucaccaguucguguccccaauuauaacaugaucauuauggaugaagcgcauuucaccgacccuucuagcaucgcagcccggggguacauaaguacaagagugggaaugggcgaggcugccgcaauuuuuaugaccgccacuccgcccgguuccguggaggcuuucccacagagcaaugcggucauccaggaugaggaaagggacauuccugagcgcucuuggaacucaggguaugaguggaucacagauuuucccggaaagaccguaugguucgugccauccauaaaaaguggcaaugacauugccaacugucugcgaaagaauggcaagagaguuauccagcucagccggaaaacguuugauacugaauaccaaaagaccaaaaauaacgacugggacuacguggucaccaccgauaucucggagaugggggcaaauuucagggcugaccgcgugauugauccucguagaugccugaagcccguuauccuuaaagacggaccagaacgggugauucuagccgguccgaugccugucacuguggcaucugccgcucagaggcgcggccgaauagggagaaaccacaauaaggagggagaucaguauaucuacaugggccagccccugaacaaugacgaggaucaugcccacuggacagaagcgaagauguuguuagacaacauuaauaccccagaggguaucauccccgcacuguucgaaccugagcgggaaaaauccgccgcuauugauggggaguauaggcuccgcggcgaggccagaaagacauuuguagaacugaugaggcggggagaccuuccaguguggcugagcuacaaaguugcuucagagggcuuccaauauagugaucgucgcuggugcuuugacggggaacgaaacaaucagguccucgaggaaaacauggauguggagauauggacuaaggagggagaaaggaaaaaguugaggccccgguggcuggacgcacgcacguacucugacccucuagcccugagagaguucaaagaauuugcugccgguaggcgguccgugagcggcgaucucauccuugagauugggaagcugccgcagcacuuaacccagcgagcacaaaaugcguuggacaaccuggucaugcuccauaauucagaacagggaggcagagccuaucgccacgcuauggaggagcugccagauacaaucgaaacucuuaugcugcucgccuugauugcaguucugaccgguggggugacauuauucuuucuaaguggcaggggacugggcaagaccagcaucgggcuccuuuguguaauggcuuccucugugcuguuguggauggccagcgucgagccccauuggauagcagccuccaucauucuggaguucuuucucauggugcugcuuaucccugagcccgaccggcagcguacuccacaggauaaccaacucgcuuacguugugauuggacuguuguucaugauccugacggucgcggccaaugagauggguuuacuagaaaccaccaaaaaggaccugggcauagggcacguagcagugggaaaccaccaucacgcugccaugcucgauguugaccuucauccugccucagcauggacucuguacgcuguggccaccacaauuaucacccccaugaugagacacacuauugagaacacaacggcgaauaucucuuugaccgcuauagccaaccaggcagccauccugaugggccucgauaaagguuggccaauuaguaagauggacaucggggucccucugcuugcuuuaggcugcuauucgcaagugaauccgcugacucucacagcagccgucuugaugcugguggcgcauuacgcuauuaucggacccggccuacaagccaaagcaaccagggaagcccagaagcgcaccgcugccgggauaaugaagaacccaacaguugauggaauuguggcaaucgaccuggauccuguaguguaugacgcuaaauuugagaagcagcucggccagaucaugcuucugauuuuguguacuagccaaauccugcucaugcggacgaccugggcccugugcgaauccauaacauuagcgacugguccccuuaccacacugugggaggggucuccaggaaaauucuggaauaccacuauugccgucucaauggcaaacaucuuucgaggcagcuaccucgcuggugccggccuagcauucucccugaugaagagucuagggggaggcagaagggggacgggagcucagggcgagacacugggugaaaaauggaagcgccagcucaaucagcuuucuaagagcgaguucaacaccuauaaacggucagggauuauggaaguugacagauccgaggccaaggaaggacugaaacguggcgagacuaccaagcacgccgugaguagggguacagcgaaauugcggugguuugucgagcgcaaucuggugaagccugaaggcaagguaaucgaucucggguguggacgaggcggguggagcuacuauugcgcuggacuaaagaaggugacugagguuaaaggcuacaccaagggugggcccggacacgaagaaccgauaccaauggcaacauacggcuggaaccuggugaaacuucauucuggcaaggacgucuucuuuaucccucccgaaaaaugugauacgcugcuaugcgacauuggggaguccucaccaaaucccaccaucgaggaaggaagaacucucagggugcugaagauggucgagccuugguugcgggguaaccaauucuguauuaagauccugaauccguauaugcccagcgugguugaaacacucgagcagaugcagcgcaaacacggcgggaugcuuguaagaaacccacugucgagaaauucuacccaugagauguacugggugaguugcggaacuggcaacauugucuccgccgugaauaugacaagccgaauguuacugaaccgguuuaccauggcucaccguaagccuacguaugaaagagauguugacuugggugccgggacccgccacguggcagucgagcccgaaguggccaaccucgauaucauaggacagaggauugagaauaucaaacaugaacacaagucaacauggcauuacgacgaggauaacccuuauaaaacuugggcuuaccacggcuccuaugagguaaagccaucuggcagcgcgaguuccauggugaaugggguugucaagcugcuaaccaaacccugggacgugaucccuauggugacacaaauugccaugacugauaccacaccauucggacagcagcgggucuuuaaggaaaaaguugacaccagaacucccaaggcaaaacgcgguacggcucaaauaauggaggugacagccaaguggcuuuggggcuuccugagcaggaacaagaaaccgcgaaucuguacccgggaagaguuuacuagaaagguaaggucuaaugcagccauuggggcuguguucgucgacgaaaaccaguggaacucagccaaagaggcgguggaggaugaacgcuuuugggaccucguucaucgugagcgggaacugcacaagcagggaaaaugcgcaaccugcguguacaacaugaugggcaagagagagaagaaauugggugaguucgggaaggccaaaggaaguagggcuaucugguacauguggcugggcgcccgcuuucucgaguucgaggcacuuggcuucaugaaugaagaucacugguuuucccgagagaacagccugucuggggucgaaggagaggguuuacauaagcugggcuauauuuugcgggacaucucgaaaauaccugggggaaauauguacgcugaugacacagccggcugggauacgagaaucaccgaggacgaucuccagaacgaagcuaggauuacugacaucauggagccagaacacgcccugcuagcaaagucaauuuucaaacuuacauaucaaaauaaggugguacgcguucagagacccgcgaagaacgguaccgugauggaugucaucagccggagggaccagcguggguccggacaggugggcacuuacggccugaauacauuuaccaacauggaggcccaacucauacgacagauggaaagugaggggauuuucucuccuagcgagcuggaaacaccaaacuuggcugagcgcguguuagauuggcuggaaaaauauggagucgagagacucaagcggauggccaucuccggugacgacuguguugugaaacccaucgaugacagguuugcaacugcucuuaccgcccugaaugauaugggcaagguacgcaaagacauuccgcagugggaaccuucaaagggguggaacgauuggcagcaagugcccuucugcagucaucacuuucaccagcuaauaaugaaggacggaagagagaucgucgugccaugucggaaucaggaugagcugguuggcagggcacgagugucucagggugccggguggagccuccgugaaacggcgugcuugggaaaauccuacgcucaaauguggcagcugauguauuuccauagacgcgaccuucggcuggccgcaaacgccauuuguucagcugucccuguggauuggauccccaccagcaggacaacuuggucuauucacgcccaucaccaguggaugaccacagaggacaugcucuccguauggaauagaguuuggaucgaagagaacccauggauggaagauaagacucauauaaguagcuggggcgacgugcccuacuuaggcaaacgcgaggaccaauggugcgggucgcugaucggauugaccgcacgggcuacgugggccacaaauauucaggucgcgaucaaccaggugaggcgacugauugguaaugagaacuaccucgauuauaugaccuccaugaagagauuuaaaaaugaaucugacccugagggcgcucuuugguga

SEQ ID NO: 13268 - RNA, 9879 nt, Artificial Sequence
  derived and/or modified CDS sequence (opt3) from DENV-1__GQ868636__SS-prME
agcgugaccaugcugcucaugcuuaugcccacagcacuggcuuuccacuugacuacgagaggaggggaaccucauaugaucgucaccaagcaggaaaggggaaaauccuuacuguuuaagacaucugccgguguuaauaugugcacucuaauugcaauggaccucggagaacugugugaagauaccaugacauacaaaugcccacggauaaccgaagcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggccagcuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggccuuggugagguggacuccuuuucacugggcuugcucuguauuaguaucaugaucgaagaggucaugaggagccgcuggucgcgaaagaugcugauggcugggacccuagccguguuccugcuccugauuaugggacagcuuacuuggaacgauuugauccggcugugcauuaugguuggcgcaaaugcuuccgaccguauggggaugggaacaaccuauuuagcccucauggcaacauuuaaaaugagaccuauguucgccgugggccugcuuuuuaggcgccugacuucucgggagguccuacuccugaccauagguuugagccugguggcuucaguugaauuaccaaacagucucgaggaacugggggauggacuugcgaugggcaucaugauucugaaguugcucacggacuuccaaucccaccagcugugggccacacuacugucucuuaccuuuaucaaaacuacccucagccugcaucacgcauggaagacaauggcuaugguguuguccauugucucacuguuccccuuaugucucagcacuaccagucagaagacgacauggcugccgguacuucugggcucuuuggggugcaaaccucucaccauguuucugaucgccgagaauaagauauggggaagaaaauccuggccacuaaacgaagguaucauggccgugggcguugugagcauucugcuuucgucacuccugaagaacgauguccccuuggcugggccuuuaaucgcaggaggcaugcugauugccuguuacgugaucucugguaguuccgcggaccucagccuggagaaagcugccgagguaucuugggaagaggaagcagagcauagcggggccucccacaauauacuuguggaaguccaggaugacggaacuaugaagauuaaagaugaggagagggacgauacacugaccaucuugcuaaaggcuacucugcucgcaaucucaggcguuuauccccugaguauuccagccacacuuuucgugugguacuuuuggcaaaagaaaaagcagcgaagcggcguguuaugggacaccccuucucccccagaagucgagcgcgcggugcuggaugacgggauauaucggaucaugcagagaggacucuuggguaggucccagguuggcguagggguguuccaagaaaacgucuuccacacgauguggcaugugacucguggagcuguucugauguaccagggcaaacgccucgagccgucaugggccagugugaagaaagaccugauuagcuauggugggggauggcggcuucagggcuccuggaauaccggcgaggaaguccaggugaucgcaguagagccugggaagaaccccaagaauguccaaacagccccaggaaccuuuaaaacacccgaaggugaggugggcgcuauugcccuggauuucaagccugggacuucuggaucgccaaucguuaacagagaaggcaaaauaguggguuuguacgggaauggagucgugaccacgagcggcacauacguuucagcaaucgcucaggccaaggcgucccaggagggcccccuaccugagauugaagacgagguguuuaggaaacgaaaccugacuaucauggaucuccacccggggaguggaaagacccggcgcuauuuaccagccauugucagagaagcaaucaagaggaaacugcggacacuuauacuggcucccacccgagugguagccucugagauggcugaagcacucaaggguaugccuauuagauaccaaacuaccgccgugaaaagcgagcauacaggcaaggagaucguugacuugaugugccacgccacguucacuaugcgccugcucuccccagucagggugcccaauuauaacaugaucauuauggaugaagcucauuuuaccgacccuucaucuaucgcggcacguggguacauaagcacacgggugggaaugggcgaggccgcugccauuuucaugaccgcaacuccgcccgguagugucgaagccuuuccacaguccaaugcuguaauccaggaugaggaaagagacauuccugagaggagcuggaacucuggguaugaguggaucacagauuuccccggaaaaaccgugugguuuguuccaucaauaaaguccggcaaugacauugcgaacugucugcgcaagaauggcaaacgagugauccagcuuaguagaaagacguucgauacugaauaccagaaaaccaagaacaacgacugggacuaugucgugaccaccgauaucagcgagaugggggccaauuuucgggcagacaggguuauugauccucgccguugccuaaaacccgugauccugaaggacggaccagaaagagucauuuuggcugguccgaugccugugacuguagccucggcagcccagcggaggggccgcauagggcgaaaccacaauaaggagggagaucaguacaucuacaugggccagcccuuaaacaaugacgaggaucacgcucauuggacagaagccaaaaugcugcucgacaacauuaauaccccagaggguaucauccccgcgcuguucgaaccugagagagaaaagucugcagccauugauggggaguaucggcuuaggggcgaggcucgcaaaacauucguggaacugaugagaaggggagaccucccaguuugguuguccuacaaggucgccagcgagggcuuucaauauucagaucggcguuggugcuucgacggggaacgcaacaaucaggugcuggaggaaaacauggauguggagauauggacuaaagagggagaacgaaagaaacuaagacccagguggcuggacgcucggacguacagugacccucucgcacuucgcgaguuuaaggaguucgccgcugguagaaggucugucuccggcgaucugaucuuagagauugggaaguugccgcagcaccugacccagcgggcccaaaaugcacucgacaaccugguuaugcuucauaauagcgaacagggaggccgagcguauagacacgccauggaggagcugccagauacaaucgaaacucucauguugcuggcuuuaauugccgugcuaaccggugggguaacacuguuuuuccucucaggccgcggacuuggcaaaaccaguaucgggcuguugugugugauggcaagcuccguccugcucuggauggcuucuguggagccccacuggauagccgcaagcaucauucuggaauuuuuccuuaugguucuccugaucccugagcccgacaggcagcggacuccacaggauaaccaauuggccuacguggucauuggacuguuauuuaugauccuaacgguagcugcgaaugagaugggucugcucgaaaccacaaagaaagaccuuggcauagggcauguggccguugagaaccaccaucacgcaacuaugcuggauguggacuugcauccugcuuccgccuggacccuguaugccgucgcaacaaccauuaucacucccaugaugcgucacacaauugaaaacacgaccgcuaauaucucacucacugccauagcgaaccaggcugccauccugaugggacuugauaagggcuggccaauuucuaaaauggacaucggugugccuuuacuggcacucgggugcuacagucaggucaauccguugacacugaccgccgcugugcuaaugcugguugcacacuacgccauuaucggccccggacuccaagcgaaggcuaccagagaggcccagaagaggacagcagccggcauaaugaaaaacccaacuguggaugggauuguagcuaucgaccuugauccuguggucuaugacgccaaguucgaaaaacagcugggacagaucauguugcugauucucuguacgucgcaaauccuguuaaugcgcaccacaugggcacuuugcgagagcauaacucuggcuaccggcccccucacaacccuaugggaggguuccccagggaaguuuuggaauacuacgauugccguuucuauggcgaacaucuuccggggaucauaccuggccggcgcagguuuggcuuuuagccugaugaaaucccucggcgggggacgaagaggcacaggggcccagggagaaacccuuggcgagaaguggaagaggcagcugaaucaguugaguaaaucugaguucaacauuuauaagcgcagcgguaucauggagguggaccggucagaagcaaaagaggggcugaagagaggagagacuacccgucaugcugucuccaggggcacagccaaacuccggugguucguggaacgcaauuuaguaaagccugaggguaaggugauagaucugggcugugggcgaggaggcuggaguuacuauugcgccgggcuuaaaaagguuacugaagugaaaggauacaccaagggcggucccgggcacgaggaaccgaucccaauggcgacauauggauggaaccuggucaaacuacauagcggcaaggacguguuuuucacgccucccgagagaugugauacccuccugugcgacauuggcgagucuuccccaaaucccacuaucgaagaggggaggacauugcggguccugaaaaugguggaaccuuggcuccgcggaaaccaauuuuguauuaagauccuuaauccguacaugcccucaguuguagagacccuggagcagaugcagagaaagcacgguggcauguuagugaggaacccacugagccgaaauucgacucacgaaauguacugggucucuugcgggacaggaaacauugugagugcuguuaauaugaccucccggauguugcucaaccguuucacgauggcacauagaaaaccuaccuaugagcgcgauguggaccugggcgccgguacaaggcacgucgcuguggaacccgagguagccaaccuagauaucauagggcagcggauugaaaauaucaagcaugagcacaaaagcacuuggcauuacgacgaggauaacccuuauaagaccugggcauaccacggaucauaugaagugaaaccauccggcucugccagcaguaugguuaauggcgucgugaaacuucugacaaagcccugggacgugaucccuauggucacucaaauugcuaugaccgauacaaccccauuugggcagcagagaguuuucaaagagaagguggacacucgcacgcccaaagcgaagaggggaacagcccaaauaauggaaguaaccgcacgauggcucugggguuuucugucccggaacaaaaagccgagaaucuguacuagggaggaguucacccgcaaggugcguagcaaugcugccauuggcgcagucuuuguggacgagaaccaguggaacucugccaaagaggcuguugaagaugagcgguucugggacuuggugcagaaggaaagagagcugcacaaacaggggaagugcgccacaugcgucuacaacaugaugggaaaaagggaaaagaagcucggcgaguuugguaaagcgaaggggucacgcgcaaucugguauauguggcuuggagcccgauuccuggaguuugaggcuuuaggcuucaugaaugaggaucauugguucagucgggaaaacucccugagcggcguggagggggagggauugcacaaacucgguuacauucugagagacaucucuaagauaccuggcgggaauauguacgccgaugacacggcaggaugggauaccaggaucacugaagacgaucuacaaaacgaggcuaaaauuacagacaucauggaaccagagcaugcccuucuggcuaccucgauuuuuaagcucacuuaucagaauaaaguaguucgcgugcagagacccgccaagaacggcacagucauggaugugaucucacggagggaccagcgugguagcgggcaagugggaaccuacggccugaauacauucacuaacauggaagcacaguugauacgacagauggaguccgagggcauauuuuuaccuagugaacuggagaccccaaaccucgcggaacgcguccuugauuggcuggagaagcacgggguugaaagacuaaaacggauggccaucucuggagacgacugugugguaaagcccaucgaugacagguucgcuacggcccugaccgcacucaaugauauggguaaagugcgcaaggacauuccgcagugggagccuagcaaaggcuggaacgauuggcaacagguccccuuuugcucccaccauuuccaccaguugauaaugaaggacgggagagagaucgugguuccaugucggaaucaggaugaacuggugggaagggcucgagucucacaaggcgccgguuggagucuucgugagacagcaugccuggggaagucuuaugcccagauguggcagcucauguacuuucauagacgcgacuuacggcuggcggcuaacgccauuuguagcgcagugccuguagauuggguucccacuuccaggaccacauggucaauccacgcccaucaccaauggaugacuaccgaagacauguugagcguguggaauagagucuggauugaggaaaacccauggauggaggauaaaacgcacgugucuuccuggggagacguucccuaucugggcaagcgcgaggaccaguggugcggcagucucaucgggcuuacagcucgggccaccugggcaagcaauauacagguggcuaucaaccaggucaggcgacugauuggaaaugaaaacuaccuagauuauaugacuucgaugaaaagauucaagaaugagggugacccugaaggcgcccugugguga

SEQ ID NO: 13269 - RNA, 9879 nt, Artificial Sequence
  derived and/or modified CDS sequence (opt3) from DENV-1__GU131922__SS-prME
uccgugaucaugcugcucaugcuuaugcccaccgcacuggcuuuccacuugacaacuagaggaggggagccucauaugauugucuccaagcaggaaagaggaaaaucuuuacuguuuaagacgucagccgguguuaauaugugcaccuugauagccauggaccucggcgagcugugugaagauacaaugacuuacaaaugcccacggaucaccgaggcggaaccggacgauguggacuguuggugcaaugcuacagauaccuggguaacuuaugggacauguagucaaaccggagagcaccgccgagacaagcguagcguggcccuugcaccccaugucggccuggguuuggagacgagaacugaaaccuggauguccucugagggggccuggaaacagauucagaggguggaaacaugggcucuccggcacccuggauucacuguuaucgcacuguuucuggcccaugcuauuggcaccucgaucacacagaagggcauaaucuucauucucuuaaugcuggugaccccaucaauggccaugcgcugcgucgggaucggaagcagagauuuuguggagggucuuaguggcgcgacguggguagacguuguguuggagcacggguccugugucacuacaauggcaaaggauaaacccacccuggacauugaacuacucaagacugaggugacaaacccugccauccugaggaaacuuugcauagaagcuaagauuucuaauaccacgaccgauagccgguguccaacacaaggagaggccacucugguggaagaacaagacgcaaacuucgucugccgccgaaccuuuguugauagaggcugggguaauggguguggauuguucggcaaaggcucccucaucacaugcgcuaaguuuaagugcgugacuaaacuggaggggaagauuguacaguacgaaaacuuaaaauauucagugaucgucaccgugcacacaggagaccagcaucaaguugguaaugagaguaccgaacacggcacuacggccacaaucacuccccaagcgccuaccaccgagauucagcugacagacuacggggcccucacccuugauuguagcccaaggacuggacuggacuucaacgaaaugguguugcuaacaaugaaggagaaaucuuggcugguccauaagcagugguuucucgaucugccgcuucccuggacguccggcgcaucaaccagccaagagacuuggaaucggcaggaccuguuggugacauucaaaaccgcucacgccaagaagcaggaaguaguugugcucgguagucaagagggggcuaugcacacagcccugacuggcgcaaccgaaauacagacgucuggaaccacaacuaucuuugccggccauuuaaaaugccgucugaagauggauaaacuaacccucaaggggauguccuaugucauguguacagguucguucaaacuggagaaggaaguggcugagacucagcacgguaccguccuugugcagauuaaguacgagggcacggacgcgccuugcaaaaucccauucucgacacaagaugaaaaggggguuacccagaacggacgcuugauaacugcaaaucccauugugacagacaaagagaagccuguaaacaucgaagccgagccacccuuuggcgagucuuauaucgucauuggugcuggggaaaaagcccugaagcucuccugguucaagaaaggcucaaguaucggaaagauguuugaggcaaccgccagaggcgcuaggcggauggccauucugggggauacugcaugggacuucggaagcauagguggcguguuuaccuccguugggaaacuugugcaucagaucuucggaacagcguacggcguccuguuuucuggugugagcuggacgaugaagauugggaucggcguauugcucaccuggcugggauuaaauucacgaaguacuucccugagcaugacauguaucgcugugggccuaguuacccucuaccugggggucauggugcaggccgauucuggaugcgugauuaacuggaaaggccgcgaacuuaagugugguucagggauauucgucacaaaugagguucacacuuggaccgaacaauauaaguuucaggcagacaguccgaaaagauugagcgccgcuaucggaaaggccugggaggagggcgugugcgguauuagguccgcaacgcggcuggaaaacaucauguggaaacagauuucuaacgagcucaaucauauccuguuagaaaacgacaugaaguucacagugguagucggcgauguggcugggauacuggcccagggcaagaagaugauccgcccucaacccauggaguacaaauauucguggaaaagcuggggcaaggcgaagauuaucggggccgacguucagaauaccacuuuuauuaucgauggaccaaacaccccugaaugucccgacgaucagagagcuuggaauauaugggagguggaggacuacggcuucgguauuuuuacaacuaacaucuggcuuaaguugagggauuccuauacccaggucugcgaccaccgucucaugucagcagccauuaaagauaguaaggcugugcacgccgacaugggguacuggaucgaaucugagaaaaaugaaacauggaagcuggcacgggcgagcuucauagagguuaagacguguaucuggccaaaaucccauacccuauggucaaacggagugcuggaaagcgagaugauuauccccaagauuuauggcgguccuaucucucaacacaauuaccgaccaggcuacuucacucagacagccgggccguggcaucucggaaaacuggagcuugauuuugacuugugcgaaggcaccacuguagucguggaugagcacugcgggaacagaggacccucccugaggacaaccacggugacuggcaagauaauucacgaaugguguugccgcaguuguaccuuaccuccacuccgguucagaggugaggacgggugcugguauggaauggagaucaggcccgucaaagaaaaggaggaaaaucugguuaagagcauggugucugcuggcuccggugagguagacucauuuagucuuggccuguuguguaucagcauuaugaucgaagaggugaugcgcucgcgauggucccggaaaaugcucaugacagggacccuggccgucuuccuacugcucauuaugggacagcugacuuggaacgaucuuauacguuugugcaucauggugggcgcaaaugcuucugacagaauggggaugggaacaaccuaccuggccuuaauggcaacauuuaagaugaggccuauguucgccguuggccuccuguuucgccggcuuacuagcagagaggugcugcuacucaccauuggucugucauuggucgcuaguguggaacugccaaacuccuuagaggaacucggggauggacuggcgaugggcaucaugauucuuaaacuguugacggacuuccaaucucaucagcucugggccacacugcuaagccugaccuuuaucaagacuaccuucucccuucacuaugcauggaaaacaauggcuaugguucucucaauagugagccuguuucccuugugucugaguacuaccucucagaagacgacaugguuaccgguccuccugggcucccuugggugcaagccucugaccauguucuugaucgccgagaauaaaauuuggggaaggcgaagcuggccacucaacgaagguaucauggccguaggcauugugucgauccugcuaucaucucugcuuaagaacgauguuccccucgcugggccucugauagcaggaggcauguugauugccuguuacgugaucagugguuccagcgcggacuuaucucuggagaaagcugccgaggucagcugggaagaggaagcagagcauuccggggccucacacaauauccucguggaaguacaggaugacggaacuaugaagauuaaagaugaggagcgcgacgauacacugaccauacuucugaaggcuacuuugcuagcagugaguggcgucuauccccugagcaucccagccacacucuuuguuugguacuucuggcagaaaaagaagcagcggucuggcgugcugugggacaccccuucacccccagaaguggagagagcgguccuugaugacgggauuuauaggaucaugcagcguggauuacugggucgcagccaggugggcguugggguauuccaagaaaacguguuucauacgauguggcacgucacucggggagcugugcucauguaccagggcaaaagauuggagccgaguugggccagcguuaagaaagaccugauuuccuacggugggggauggaggcuccagggcucuuggaauaccggcgaggaagugcaggucaucgcaguggagccugggaagaaccccaaaaauguacaaacagccccaggaaccuucaagacacccgaaggugaggucggcgcuauagcccuggauuuuaagccugggacuucgggaagcccaaucgugaaccgagaaggcaaaauuguuggucuuuaugggaauggaguggucaccacgucaggcacauacguguccgcaaucgcucaggccaaggcgagucaggagggcccccugccugagauugaagacgagguuuuccggaaacgcaacuugacuaucauggaucuacacccggggucuggaaagaccagaagguaucugccagccauagugcgggaagcaauuaaacgaaagcucagaacauuaauccuggcucccacccgcgucguggccagcgagauggcugaagcacuuaaggguaugccuaucagguaccaaacuaccgccguaaaauccgagcauacaggcaaggagauuguggaccugaugugccacgccacguuuacuaugcgucucuugucaccaguucggguccccaauuauaacaugaucauaauggaugaagcucauuucaccgacccuucuagcauugcggcaagaggguacaucaguacaagggugggaaugggcgaggccgcugccauuuuuaugaccgcaacuccgcccgguuccguggaagccuucccacagagcaaugcugucauccaggaugaggaacgcgacauaccugagcgaucuuggaacucaggguaugaguggauuacagauuuucccggaaaaaccguaugguucgugccauccaucaagaguggcaaugacaucgcgaacugucugaggaaaaauggcaagcggguuauucagcucagcaggaagacguuugauacugaauaccagaaaacaaagaacaacgacugggacuacguggucaccaccgauaucucggagaugggggccaauuuccgcgcagaccgugugauugauccuagacggugccugaaacccguuauacuuaaggacggaccagaaagggugauccuagcugguccgaugccugucacuguggccucugcagcccagcgccgaggcagaauugggcggaaccacaauaaagagggagaucaguauaucuacaugggccagccccugaacaaugacgaggaucaugcucacuggacagaagccaagauguuguuagacaacaucaauaccccagaggguauuauacccgcgcuguucgaaccugagagggaaaaguccgcagccaucgauggggaguaucgccucagaggcgaggcuaggaaaacauuuguagaacugaugcggcguggagaccuuccaguguggcugagcuacaagguugccucagagggcuuccaauauagugaucgccgauggugcuuugacggggaaagaaacaaucagguccucgaggaaaacauggauguggagauuuggacuaaagagggagaaaggaagaaauugcggccccgcuggcuggacgcuagaacguacucugacccucuagcacugagggaguucaaggaauuugccgcuggucggcgauccgugagcggcgaucucauccuugagauugggaaacugccgcagcacuuaacccagagagcccaaaaugcauuggacaaccuggucaugcuccauaauucagaacagggaggccgcgcguauaggcacgccauggaggagcugccagauacaaucgaaacucuuaugcugcucgcuuugauagccguucugaccgguggggugacauuauucuuucuaaguggccggggacugggcaagaccagcaucgggcuccuuuguguaauggcauccucugugcuguuguggauggcuagcgucgagccccauuggauugccgcauccaucauucuggaguucuuucucauggugcugcuuaucccugagcccgaccgucagagaacuccacaggauaaccaacucgccuacguugugauaggacuguuguucaugauucugacggucgcugcgaaugagauggguuuacuagaaaccacaaagaaagaccugggcaucgggcacguagccgugggaaaccaccaucacgcagcuaugcucgauguugaccuucauccugccucagccuggacucuguacgcaguggcuaccacaauuaucacccccaugaugaggcacacuauagagaacacaacggccaauaucucuuugaccgcgauugcuaaccaggccgcaauccugaugggccucgauaaggguuggccaauuaguaaaauggacaucggggucccucugcuugccuuaggcugcuauagccaggugaauccgcugacucucacagcugcagucuugaugcugguggcccauuacgcgauaauuggacccggccuacaagcuaaggccacccgcgaagcacagaaacggaccgccgcugggaucaugaagaacccaacaguugauggaaucguggccauugaccuggauccuguaguguaugacgcaaaguuugagaaacagcucggccagaucaugcuucugauauuguguacuagccaaauucugcucaugcgaacgaccugggcucugugcgaauccaucacauuagccacugguccccuuaccacacugugggaggggucuccaggaaaguucuggaauaccacuauugcggucucaauggccaacaucuuuagaggcagcuaccucgcaggagcuggccuagccuucucccugaugaaaagucuagggggaggcaggcgcgggacgggagcacagggcgagacacugggugaaaaguggaaacggcagcucaaucagcuuucuaagagcgaguucaacaccuauaagagaucagggauaauggaaguugaccguuccgaggcuaaagaaggacugaagaggggcgagacuaccaaacacgccgugagucgggguacagccaaguugcgcugguuugucgagcgaaaucuggugaaaccugaaggcaagguaaucgaucucggguguggaagaggcggguggagcuacuauugcgcgggauuaaagaaagugacugagguuaagggcuacaccaaaggugggcccggacacgaagaaccgauuccaauggcuacauacggcuggaaccuggugaaacuucauucuggcaaagacgucuucuuuaucccucccgaaaagugugauacgcugcuaugcgacauuggggaguccucaccaaaucccaccaucgaggaaggaaggacucuccgggugcugaaaauggucgagccuugguugcgcgguaaccaauucuguauuaagauccugaauccguauaugcccagcgugguugaaacacucgagcagaugcagagaaagcacggcgggaugcuuguaaggaacccacugucgcgaaauucuacccaugagauguacugggugaguugcggaacuggcaacauagucuccgcagugaauaugacaagccggauguuacugaaccguuuuaccauggcccacagaaaaccuacguaugaacgcgauguugacuugggugcugggaccaggcacguggccgucgagcccgaaguggcaaaccucgauauuaucggacagcggaucgagaauauuaagcaugaacacaaaucaacauggcauuacgacgaggauaacccuuauaagacuugggccuaccacggcuccuaugagguaaaaccaucuggcagcgcuaguuccauggugaaugggguugucaagcugcuaaccaagcccugggacgugauaccuauggugacacaaaucgcgaugacugauaccacaccauucggacagcagagagucuuuaaagaaaagguugacacccgcacucccaaagccaagagggguacggcacaaauuauggaggugacagcuaaauggcuuuggggcuuccugagccgaaacaagaagccgcggaucuguaccagagaagaguuuacuaggaaaguacgcucuaaugccgcaauuggggccguguucgucgacgaaaaccaguggaacucagcuaaggaggccguggaggaugaacguuuuugggaccucguucauaaagagcgggaacugcacaagcagggaaaaugcgcgaccugcguguacaacaugaugggcaagagagagaagaaauugggugaguucgggaaggcaaaaggaaguagggccaucugguacauguggcugggcgcucgcuuucucgaguucgaggcccuuggcuucaugaaugaagaucacugguuuucccgagagaacagccugucuggggucgaaggagaggguuuacauaagcugggcuauauauugcgggacaucucgaaaauuccugggggaaauauguacgcagaugacacagcuggcugggauacgagaaucaccgaggacgaucuccagaacgaagccaggauuacugacaucauggagccagaacacgcucugcuagccaagucaauauucaaacuuacauaucaaaauaaggugguacgcguucagagacccgcaaagaacgguaccgugauggaugucauuagccggagggaccagcguggguccggacaggugggcacuuacggccugaauacauuuaccaacauggaggcgcaacucauccgacagauggaaagugaggggaucuucucuccuagcgagcuggaaacaccaaacuuggccgagcgcguguuagauuggcuggaaaaauauggagucgagagacucaagcggauggcuauuuccggugacgacuguguugugaaacccauagaugacagguuugccacugcacuuaccgcucugaaugauaugggcaagguacgcaaagacaucccgcagugggaaccuucaaagggguggaacgauuggcagcaagugcccuucugcagucaucacuuucaccagcuaauuaugaaggacggaagagagaucgucgugccaugucggaaucaggaugagcugguuggcagggcccgagugucucagggugcaggguggagccuccgugaaacggccugcuugggaaaauccuacgcgcaaauguggcagcugauguauuuccauagacgcgaccuucggcuggcugccaacgcaauuuguucagccgucccuguggauuggauccccaccagcaggacaacuuggucuauacacgcucaucaccaguggaugaccacagaggacaugcucuccguauggaauagaguuuggaucgaagagaacccauggauggaagauaagacucauauuaguagcuggggcgacgugcccuacuuaggcaaacgcgaggaccaauggugcgggucgcugaucggauugaccgcccgggcaacgugggcuacaaauauucaggucgccaucaaccaggugaggcgacugauugguaaugagaacuaccucgauuauaugaccuccaugaagagauuuaaaaaugaaucugacccugagggcgcgcuuugguga

SEQ ID NO: 13270 - RNA, 9879 nt, Artificial Sequence
  derived and/or modified CDS sequence (opt3) from DENV-1__GU131923__SS-prME
uccgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaauaugugcacauuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacaguuguggauagaggcugggguaauggguguggauuguuuggcaaaggcucccucauuacuugcgcuaaguucaagugcguaaccaaacuggaggggaagaucgugcaguacgaaaacuuaaaauauucagucauugugacaguucacaccggagaccagcaucaaguggguaaugagaguacugaacacggcacgacagccaccaucacuccccaggcgccuaccacagagauccagcugaccgacuacggggcccucacucuugauuguagcccaaggacaggacuggacuuuaacgaaauggucuugcuaacgaugaaggagaaaucuuggcuggugcauaagcagugguuccucgaucugccgcuucccuggaccuccggcgcaucaacuagccaagagacauggaaucggcaggaccuguugguaaccuuuaaaacagcucacgccaagaagcaggaaguugugguccucgguagucaagagggggcuaugcacacugcccugaccggcgcaacggaaauucagaccucuggaacaacuaccauauucgccggccauuuaaaaugccgucugaagauggauaaacuaacacucaaggggauguccuaugugauguguacugguagcuuuaaacuggagaaggaagucgcugagacccagcacgguacggugcuuguucagaucaaguacgagggcacagacgcgccuugcaaaauuccauucucgacccaagaugaaaaggggaucacucagaacggacgcuugauaacagcaaaucccauugugaccgacaaagagaagccuguaaacaucgaagccgagccacccuucggcgagucuuauaucgucauuggugcuggggaaaaagcccugaagcucuccugguuuaagaaaggcucaaguaucggaaagauguucgaggcaacugccagaggcgcuaggcggauggccauucugggggauaccgcaugggacuuuggaagcauagguggcguguucacauccguugggaaacuugugcaucagaucuuuggaacggcguacggcguccuguucucuggugugagcuggaccaugaagauugggaucggcguauugcucacuuggcugggauuaaauucacgaaguacaucccugagcaugaccuguaucgcugugggccuaguuacacucuaccugggggucauggugcaggccgauucuggaugcgugauuaacuggaaaggccgcgaacuuaagugugguucagggauauuugucacuaaugagguucacaccuggacggaacaauauaaguuccaggcagacaguccgaaaagauugagcgccgcuaucggaaaggccugggaggagggcgugugcgguauuagguccgcaacacggcuggaaaacaucauguggaaacagauuucuaacgagcucaaucauauccuguuagaaaacgacaugaaguuuaccgugguagucggcgauguggcugggauacuggcccagggcaaaaagaugauccgcccucaacccauggaguacaaauauucguggaaaagcuggggcaaggcgaaaauuaucggggccgacguucagaauacuaccuucauuaucgauggaccaaacacaccugaaugucccgacgaucagagagcuuggaauauaugggagguggaggacuacggcuuugguauuuucacuaccaacaucuggcuuaaguugagggauuccuauacacaggucugcgaccaccgucucaugucagcagccauuaaagauaguaaggcugugcacgccgacaugggguacuggaucgaaucugagaaaaaugaaacguggaagcuggcacgggcgagcuuuauagagguuaagaccuguaucuggccaaaaucccauacucuauggucaaacggagugcuggaaagcgagaugauuauccccaagauuuauggcgguccuaucucucaacacaauuaccgaccaggcuacuucacacagaccgccgggccguggcaucucggaaaacuggagcuugauuucgacuugugcgaaggcacuacaguagucguggaugagcacugcgggaacagaggacccucccugaggaccacgacugugaccggcaagauaauucacgaaugguguugccgcaguuguacauuaccuccacuccgguuuagaggugaggacgggugcugguauggaauggagaucaggcccgucaaagaaaaggaggaaaaucugguuaagagcauggugucugcuggcuccggugagguagacucauucagucuuggccuguuguguaucagcauuaugaucgaagaggugaugcgcucgcgauggucccggaaaaugcucaugaccgggacucuggccgucuuucuacugcucauuaugggacagcugacauggaacgaucuuauacguuugugcaucauggugggcgcaaaugcuucugacagaauggggaugggaaccacauaccuggccuuaauggcaacuuucaagaugaggccuauguuugccguuggccuccuguuccgccggcuuaccagcagagaggugcugcuacucacgauuggucugucauuggucgcuaguguggaacugccaaacuccuuagaggaacucggggauggacuggcgaugggcaucaugauucuuaaacuguugacagacuuucaaucucaucagcucugggccacccugcuaagccugacuuucaucaagaccacauuuucccuucacuaugcauggaaaacuauggcuaugguucucucaauagugagccuguuccccuugugucugaguaccacgucucagaagacaaccugguuaccgguccuccugggcucccuugggugcaagccucugacuauguuuuugaucgccgagaauaaaauuuggggaaagaggagcuggccacucaacgaagguaucauggccguaggcauugugucgauccugcuaucaucucugcuuaaaaacgauguuccccucgcugggccucugauagcaggaggcauguugauugccuguuacgugaucagugguuccagcgcggacuuaucucuggagaaggcugccgaggucagcugggaagaggaagcagagcauuccggggccucacacaauauccucguggaaguacaggaugacggaacaaugaaaauuaaggaugaggagcgagacgauacccugacuauacuucugaaagcuacauugcuagcagugaguggcgucuauccccugagcaucccagccacccucuucguuugguacuuuuggcaaaagaagaaacagcgcucuggcgugcugugggacacgccuucacccccagaaguggagcgggcgguccuugaugacgggauuuauagaaucaugcagaggggauuacugggucguagccaggugggcguugggguauuccaagaaaacguguuccauacuauguggcacgucacccgcggagcugugcucauguaccagggcaagcgguuggagccgaguugggccagcguuaaaaaggaccugauuuccuacggugggggauggagacuccagggcucuuggaauacaggcgaggaagugcaggucaucgcaguggagccugggaaaaaccccaagaauguacaaaccgccccaggaacauuuaagacucccgaaggugaggucggcgcuauagcccuggauuucaaaccugggaccucgggaagcccaaucgugaacagggaaggcaagauuguuggucuuuaugggaauggaguggucacgacaucaggcacuuacguguccgcaaucgcucaggccaaagcgagucaggagggcccccugccugagauugaagacgagguuuuucgaaagcggaacuugaccaucauggaucuacacccggggucuggaaaaacacgcagauaucugccagccauagugagggaagcaauuaagcggaagcuccgaaccuuaauccuggcucccacuagagucguggccagcgagauggcugaagcacuuaaagguaugccuauccgcuaccaaaccacagccguaaaguccgagcauacgggcaaagagauuguggaccugaugugccacgccacuuucaccaugaggcucuugucaccaguucguguccccaauuauaacaugaucauaauggaugaagcucauuuuacagacccuucuagcauugcggcacggggguacaucaguaccagagugggaaugggcgaggccgcugccauuuucaugacugcaacaccgcccgguuccguggaagccuuuccacagagcaaugcugucauccaggaugaggaaagggacauaccugagcgcucuuggaacucaggguaugaguggauuaccgauuuccccggaaagacgguaugguuugugccauccaucaaaaguggcaaugacaucgcgaacugucugcgaaagaauggcaagagaguuauucagcucagccggaaaacuuucgauacagaauaccaaaagaccaaaaacaacgacugggacuacguggucaccacugauaucucggagaugggggccaauuuuagggcagaccgcgugauugauccucguagaugccugaagcccguuauacuuaaagacggaccagaacgggugauccuagcugguccgaugccugucacaguggccucugcagcccagaggcgcggccgaauugggagaaaccacaauaaggagggagaucaguauaucuacaugggccagccccugaacaaugacgaggaucaugcucacuggaccgaagccaagauguuguuagacaacaucaauacaccagaggguauuauacccgcgcuguucgaaccugagcgggaaaaauccgcagccaucgauggggaguauaggcuccgcggcgaggcuagaaagacuuucguagaacugaugaggcggggagaccuuccaguguggcugagcuacaaaguugccucagagggcuuucaauauagugaucgucgcuggugcuucgacggggaacgaaacaaucagguccucgaggaaaacauggauguggagauuuggacgaaggagggagaaaggaaaaaguugaggccccgguggcuggacgcucgcaccuacucugacccucuagcacugagagaguuuaaagaguucgccgcugguaggcgguccgugagcggcgaucucauccuugagauugggaagcugccgcagcacuuaacacagcgagcccaaaaugcauuggacaaccuggucaugcuccauaauucagaacagggaggcagagcguaucgccacgccauggaggagcugccagauacuaucgaaacccuuaugcugcucgcuuugauagccguucugacagguggggugaccuuauuuuuccuaaguggcaggggacugggcaagacuagcaucgggcuccuuuguguaauggcauccucugugcuguuguggauggcuagcgucgagccccauuggauugccgcauccaucauucuggaauuuuuccucauggugcugcuuaucccugagcccgaccggcagcguacgccacaggauaaccaacucgccuacguugugauaggacuguuguuuaugauucugaccgucgcugcgaaugagauggguuuacuagaaacaacuaaaaaggaccugggcaucgggcacgaggccguaggaaaccaccaucacgcagcuaugcucgauguggaccuucauccugccucagccuggacccuguacgcaguugcuacaaccauuaucacucccaugaugagacacacaauagaaaacacgaccgccaauaucucuuugacugcgauugcuaaccaggccgcaauccugaugggccucgauaaagguuggccaauuaguaagauggacaucggggugccucugcuugccuuaggcugcuauucgcaggucaauccgcugacacucaccgcugcaguguugaugcuggucgcccauuacgcgauaauuggacccggccuacaagcuaaagccaccagggaggcacagaagcgcacagccgcugggaucaugaagaacccaacuguggauggaaucguugccauugaccuggauccugugguauaugacgcaaaauucgaaaagcagcucggccagaucaugcuucugauauuguguacgagccaaauucugcucaugcggaccacaugggcucugugcgaguccaucacuuuagccaccgguccccuuacaacccugugggaggggucuccaggaaaauuuuggaauacuacgauugcggugucaauggccaacaucuuccgaggcagcuaccucgcaggagcuggccuagccuuuucccugaugaagagucuagggggaggcagaagggggacaggagcacagggcgaaacccugggugagaaauggaagcgccagcucaaucagcuuucuaagagcgaguucaacacuuauaaacggucagggauaauggaggucgacagauccgaagcuaaggagggacugaaacguggcgagaccacaaagcacgccguuaguagggguacugccaaauugcggugguucguggaacgcaaucuggucaagccugagggcaaggugaucgaucucggguguggacgaggcggguggagcuacuauugcgcgggacuaaagaagguaaccgaagugaaaggcuacacaaagggugggcccggacacgaggaaccgauuccaauggcuacguacggcuggaaccugguuaaacuucauucuggcaaggacguguuuuucaucccucccgagaaaugugauacccugcuaugcgacauuggggaguccucaccaaaucccacuaucgaagagggaagaacacucaggguccugaagaugguggaaccuugguugcgggguaaccaauuuuguauuaagauccugaauccguauaugcccagcgucguggagacccucgagcagaugcagcgcaaacacggcgggaugcuuguuagaaacccacugucgagaaauucuacucaugaaauguacuggguaaguugcggaacaggcaacauaguguccgcagucaauaugaccagccgaauguuacugaaccgguucacgauggcccaccguaagccuaccuaugagagagauguggacuugggugcugggacacgccacguugccguggaacccgaggucgcaaaccucgauauuaucggacagaggaucgaaaauauuaaacaugagcacaagucaacuuggcauuacgacgaggauaacccuuauaaaaccugggccuaccacggcuccuaugaagugaagccaucuggcagcgcuaguuccaugguaaauggggugguuaagcugcuaacaaaacccugggacgucauaccuauggugacucaaaucgcgaugaccgauacaaccccauuuggacagcagcggguguucaaggagaaagucgacacuagaacgcccaaggccaaacgcgguacagcacaaauuauggaaguuaccgcuaaguggcuuuggggcuuucugagcaggaacaagaaaccgcgaaucuguacucgggaggaguucaccagaaaggugaggucuaaugccgcaauuggggccguauuuguggacgagaaccaguggaacucagcuaaagaggccgucgaagaugagcgcuucugggaccucgugcaucgugaacgggagcugcacaagcagggaaaaugcgcgacaugcguuuacaacaugaugggcaagagagaaaagaaauugggugaguuugggaaggcaaaaggaaguagggccaucugguacauguggcugggcgcucgcuuccucgaguuugaagcccuuggcuucaugaaugaggaucacugguucucccgagaaaacagccugucugggguggagggagaggguuuacauaagcugggcuauauauugcgggacaucucgaaaauuccugggggaaauauguacgcagaugacacggcuggcugggauaccagaaucacugaagacgaucuccagaacgaggccaggauuacagacaucauggaaccagagcacgcucugcuagccaagucaauauuuaaacuuaccuaucaaaauaaggucgugcgcguacagagacccgcaaagaacgguacuguuauggaugugauuagccggagggaccagcguggguccggacaggucggcacauacggccugaauaccuucacaaacauggaagcgcaacucauccgacagauggagagugaggggaucuuuucuccuagcgaacuggagacuccaaacuuggccgaacgcguguuagauuggcuggagaaauauggaguggaaagacucaagcggauggcuauuuccggugacgacugugucguuaaacccauagaugacagguucgccaccgcacuuacggcucugaaugauaugggcaaggugcgcaaagacaucccgcagugggagccuucaaagggguggaacgauuggcagcaaguacccuuuugcagucaucacuuccaccagcuaauuaugaaggacggaagagagaucguggucccaugucggaaucaggaugaacuggugggcagggcccgaguuucucagggugcaggguggagccuccgugagaccgccugcuugggaaaauccuacgcgcaaauguggcagcugauguauuuucauagacgcgaccuucggcuggcugccaacgcaauuuguucagccgugccugucgauuggauccccacaagcaggacuaccuggucuauacacgcucaucaccaguggaugacaacugaagacaugcucuccguguggaauagaguauggaucgaggaaaacccauggauggaggauaagacccauauuaguagcuggggcgacguucccuacuuaggcaaacgcgaggaccaauggugcgggucgcugaucggauugacggcccgggcaacaugggcuaccaauauucagguggccaucaaccaggucaggcgacugauugguaaugaaaacuaccucgauuauaugacuuccaugaagagauucaaaaaugagucugacccugaaggcgcgcuuugguga

SEQ ID NO: 13271 - RNA, 9879 nt, Artificial Sequence
  derived and/or modified CDS sequence (opt3) from DENV-1__GQ868637__SS-prME
agcgugacaaugcugcucaugcuuaugcccacagcacuggcuuuccacuugacuacgagaggaggggaaccucauaugaucgucuccaagcaagaaaggggaaaaucuuuacuguuuaagaccucagccgguguuaacaugugcacauuaauugccauggaccucggcgaacugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaggguugaaacuugggcccuccggcacccuggauucaccgugauugcucuguuucuggcacaugccaucggcacaucgauuacccagaagggcaucauauucauccucuuaaugcuggucacgccaucaauggcuaugcgcugcguggggauuggaagcagagauuuuguagagggucuuaguggcgccacuuggguugacguggucuuggagcacggguccugugugacaaccauggcgaaggauaaacccacucuggacaucgaacuacucaagacagaggugaccaacccugcaguccugaggaaacuuugcauugaagccaagaucucuaauacgaccacagauagccgguguccaacucaaggagaggcuacccugguugaagaacaggacgccaacuucgugugccgccgaacauuuguagauagaggcugggguaauggguguggauuguucggcaaaggcucccucauaacuugcgcaaaguuuaagugcgugaccaaacuggaggggaagauuguccaguacgaaaacuuaaaauauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaaggacuggacuggacuucaacgaaaugguguugcuaacaaugaaggagaaauccuggcugguacauaagcagugguuucucgaucugccgcuucccuggacgucaggcgccagcaccagucaagagacuuggaaucggcaggaccuguugguuacauucaaaaccgcacacgcuaagaagcaggaaguggucgugcucgguucucaagagggggccaugcacacagcucugacuggcgccaccgaaauccagacguccggaaccacaacuauuuuugcaggccauuuaaaaugccgucugaagauggauaaacuaacccucaaggggaugagcuaugucauguguacaggaucguucaaacuggagaaggaaguggccgagacucagcacgguaccguucuugugcagauaaaguacgagggcacggacgcuccuugcaaaaucccauucucuacacaagaugaaaaggggguaacccagaacggacgcuugauuacugcgaaucccaucgucacagacaaagagaagccugugaacauagaagcagagccacccuuuggcgaguccuauauuguuaucggugccggggaaaaagcucugaagcucucaugguucaagaaaggcaguagcaucggaaagauguuugaggccaccgcaagaggcgccaggcggauggcuauucugggggauacugccugggacuucggauccaucgguggcguguuuaccucugucgggaaacuugugcaucagauuuucggaacagcauacggcguacuguuuagcggugugucauggacgaugaagauagggaucggcguuuugcucaccuggcugggauuaaauagucgauccacuagccugucuaugacauguauugcggucggccuagugacccucuaccugggggugaugguccaggcugauucaggaugcguuaucaacuggaaaggccgcgaacuuaagugugguagugggaucuucgugacaaaugaggugcacacuuggaccgaacaauauaaguuucaggccgacagcccgaaaagauuguccgcagccauuggaaaggcuugggaggagggcguaugcgguauaaggucugccacgcggcuggaaaacaucauguggcgccagauuucgaacgagcucaaucauauccuguuagaaaacgacaugaaauucacagucgugguuggcgauguggucgggauucuggcacagggaaagaaaaugaucagaccucaacccauggagcacaaguacagcuggaaauccuggggcaaggcuaagauaaucggggccgacgugcagaauaccacuuuuauuaucgauggaccaaacaccccugaaugucccgacgaucagagggcguggaauauuugggagguugaggacuauggcuucgguaucuuuacaacuaacauauggcuuaaauugcgugauucauacacccaggugugcgaccaccggcucaugagugccgcuauuaaggauucuaaagcaguacaugccgacaugggguauuggaucgaaagcgagaagaaugaaacauggaaacuggcucgagccuccuucauugaggucaagacguguaucuggccaaagucacacacccuauggagcaacggagugcuggaaucugagaugauaauccccaaaauuuacggcgguccuaucucccaacauaauuauagaccaggcuacuucacucagacagcagggccguggcaccucggaaagcuggagcuugauuuugacuugugcgaaggcaccacuguggucguugaugagcacugcgggaacaggggacccagucugcgcacaaccacggugacuggcaaaauuauccaugaaugguguugccggagcuguaccuuaccuccacucagauucaagggugaggacgggugcugguacggaauggagauaaggcccguaaaagaacgcgaggaaaaucuggugaagucuauggucuccgcgggcucaggugagguggacaguuuuagccuuggccuguuguguauuucgaucaugaucgaagagguuaugcgaucccgguggucucguaagaugcucaugacagggacccuggccguguucuuucuacugauuaugggacagcucacuuggaacgaucugaucagacuuugcauuauggucggcgcuaaugccagcgacaggauggggaugggaacaaccuauuuggcacugauggcuacauucaaaaugcgcccuauguuugccgugggcuuacucuuccggagacugacuucaagggagguucuucugcuaaccauaggucucagucugguggcauccgucgaauugccaaacucucuggaggaauuaggggauggacucgccaugggcaucaugauucugaaacuucugacggacuuucaaagccaccaguugugggcuacacuccugucccuaaccuucaucaaaacuaccuuuucacugcauuacgcguggaagacaauggccaugguacuuagcauugugagucuccugcccuugugucugucuacuaccucccagaaaacgacaugguuaccgguucuccugggcagccuugggugcaagccucugaccauguucuugaucgcagagaauaagauauggggacgaaaaucguggccacucaacgaagguaucauggcugugggcauugucucaauccugcuaucuagucugcuuaagaacgaugugccccucgccgggccucugauugccggaggcauguugaucgcuuguuauguaauauccgguagcucugcagacuuaagccuggagaaagccgcggagguguccugggaagaggaagcugagcacucaggggccagucauaauauucucgucgaaguucaggaugacggaacuaugaagaucaaagaugaggagcgcgacgauacacugaccauccuucugaaggcaacuuugcuagccgugagcggcguguacccccugucuauuccagcuacacucuuugucugguauuucuggcagaagaagaagcagcgguccggcgugcugugggacaccccuucacccccagaaguugagagagcaguacuugaugacgggauauacaggaucaugcagcguggauuacugggucgcagucaggugggcgucgggguguuccaagaaaacguuuuucacacgauguggcacgugacucggggagccguccucauguaucagggcaaaagauuggagccgagcugggcguccgugaagaaagaccugauuucuuacggugggggauggaggcuccagggcucguggaauaccggcgaggaaguacaggucaucgcuguggagccugggaagaaccccaaaaauguucaaacagccccaggaaccuucaagacacccgaaggugaggugggcgcaauugcccuggauuuuaagccugggacuagcggaucaccaaucgucaaccgagaaggcaaaauagugggucuuuacgggaauggaguugugaccacguccggcacauaugucagugcuaucgcccaggcaaaggcuucucaggagggcccccugccugagauugaagacgagguguuccggaaacgcaacuugacuaucauggaucuacauccggggagcggaaagaccagaagguaccugccagccauuguacgggaagcgaucaaacgaaagcucagaacauuaauacuggcccccacccgcgugguugcauccgagauggcugaagcccuuaaggguaugccuauuagguaucaaacuaccgcugucaaaucagagcacacaggccgugagaucguggaccugaugugccaugcaacguuuacuaugcggcucuugucuccagugagaguccccaauuacaacaugaucauuauggaugaagcccacuucaccgacccuagcaguaucgccgcuaggggguauauauccacacgcguaggaaugggcgaggcggcagccauuuuuaugaccgcuacuccgcccgguagcguggaagccuucccacagucuaaugcaguuauccaggaugaggaacgagacauuccugagagaucauggaacuccggguacgaguggaucacagauuuucccggaaagaccgugugguucgucccaaguauaaaaagcggcaaugacauugccaacugucugcggaagaauggcaaaagggugauccagcucucgcgcaagacguuugauacugaauaucaaaagaccaagaacaacgacugggacuacguugugaccaccgauaucucugagaugggggcuaauuuccgugcggacagagucauugauccucggaggugccugaagcccgugauccuuaaagacggaccagaacgcguaauucuagccgguccgaugccugugacuguugcauccgcugcccagcgaagaggccggauagggaggaaccauaauaaggagggagaucaguacaucuauaugggccagccccugaacaaugacgaggaucacgcacacuggacagaagccaaaauguuguuagacaacauuaauaccccagaggguaucauccccgcucuguucgaaccugagcgcgaaaagagcgccgcgauugauggggaguacagacucaggggcgaggcacggaagacauuugucgaacugaugcgucgcggagaccuuccaguguggcugucauauaaaguggccagugagggcuuccaauacucugaucgaagauggugcuuugacggggaaaggaacaaucagguccucgaggaaaacauggauguugagauauggacuaaggagggagaacggaaaaaguugcgccccagauggcuggacgcuaggacguauuccgacccucuagcccugcgggaguucaaagaauuugcugcaggucgaagaagcgugucaggcgaucucauccuugagauugggaagcugccgcagcauuuaacccagcgcgcccaaaaugcuuuggacaaccugguaaugcuccacaauagugaacagggaggcagggccuaccggcaugcaauggaggagcugccagauacaaucgaaacucuuaugcugcucgcguugauugccgugcugaccgguggggucacauuauucuuucuaagcggccguggacugggcaaaaccuccaucgggcuccuuugugugauggcuucuagcgcccuguuguggauggcauccguugagccccacuggauagcugccucaaucauucuggaguucuuucucauggugcugcuuaucccugagcccgacagacagaggacuccacaggauaaccaacucgcauaugucguaauuggacuguuguucaugauccugacgguggccgcuaaugagauggguuuacuagaaaccacaaagaaggaccugggcauagggcacguugcgguggagaaccaucaccaugccacuaugcucgaugucgaccuucacccugcaucugcuuggacccuguacgccguggccacaaccauuaucacucccaugaugcgccauacaauugaaaacacgaccgcaaauaucaguuugacugcuauagccaaccaggcggcuauccugaugggacucgauaaaggcuggccaauuucgaagauggacaucggugucccucugcuugccuuagggugcuacagccaggugaauccgcugacacucauugcagccguuuugaugcugguggcucacuaugcaaucauaggccccggacuacaagccaaagcgacccgggaggcucagaagcgaaccgccgcaggcauuaugaaaaacccaacaguagaugggaucguggccaucgaccuggauccugucguuuacgacgcuaaguuugaaaagcagcucggacagauuaugcuucugaucuuguguacuucccaaauacugcucaugagaacgaccugggcccugugcgagucuauuacauuagcaacuggcccccuuaccacacugugggaggguucaccagggaaauucuggaauaccacuaucgcugugagcauggccaacauuuuuaggggauccuaucucgcgggcgccggucuagcauucagucugaugaagucuuugggcgggggacgccggggcacgggggcucagggagaaacacugggcgagaaauggaagagacagcucaaucagcuuagcaaaucagaguucaacaccuacaagcguuccgguaucauggaggucgacaggagugaagccaaggaggggcugcggcgcggagagacuaccaaacacgcagugagccgaggcacagcuaaguugagaugguuuguagaaaggaaucuggugaaaccugaggguaagguuauagaucucggcugugggcggggaggcuggucuuauuacugcgccgggcugaaaaaggugacugaagucaagggauauaccaaaggcggucccgggcaugaggaaccgaucccaauggccacauacggauggaaccuagugaaacuucacuccggcaaagacgucuucuuuauuccucccgagaagugugauacgcugcuaugcgacaucggcgagucaagcccaaaucccaccauugaagaggggcgcacucucagagugcugaaaaugguugaaccuugguugaggggaaaccaauucuguaucaagauucugaauccguacaugcccucgguaguggagacacucgagcagaugcagcgaaaacaugguggcaugcuuguccggaacccacugucucguaauaguacccacgaaauguauuggguguccugcgggacuggaaacaucguuagcgcggugaauaugacaucaagaauguuacugaaccgcuuuaccauggcucacaggaagccuacguacgagcgggaugucgacuugggcgcagguaccagacauguggccguagaacccgagguggcuaaccucgauauaauugggcagcgcaucgaaaauaucaagcacgagcauaaauccacauggcacuaugacgaggauaacccuuacaagacuugggccuaucauggaucuuacgaaguuaaaccaagcggcagugcauccagcauggucaauggcguggugaagcugcuaaccaaacccugggacgucauuccuaugguuacacaaauagccaugacugauaccacaccauucgggcagcagaggguguuuaaggagaagguagacacccgaacucccaaagcuaagcggggaacggcgcaaaucauggaagugacagccagauggcuuugggguuuccugucuaggaacaaaaagccgcgcauuuguacccgugaggaauuuacucggaaagucagaucaaaugcagcuaucggcgccguguucguugacgagaaccaguggaauagugcaaaggaggccguggaagaugagagguuuugggaccucguccaccgcgaacgagagcugcacaagcaggggaaaugcgcuaccugcguguauaacaugaugggaaagcgggagaaaaaguugggcgaguucgguaaagccaagggguccagagcgauuugguacauguggcugggagcaagguuucucgaguucgaagcccuuggcuucaugaaugaggaucauugguuuagccgcgaaaacucucugucgggcguagagggggagggauuacacaagcuggguuacaucuugagagacauaucaaaaaucccuggcgggaauauguaugcugaugacacagccggaugggauacgcggauuaccgaagacgaucuccagaacgaggcaaagaucacugacauuauggaaccagagcaugcucugcuagccacaagcaucuucaaacuuaccuaccaaaauaagguugugaggguccagcgucccgcuaaaaacggcacugugauggaugugauaucccgacgcgaccagagagguagugggcaggucggaacauauggccugaauaccuuuacaaacauggaagcccaacucauucggcagauggagucugagggcaucuucagcccuuccgaacuggagacuccaaacuuggcagaaaggguuuuagauuggcuggagaaguacgggguggaacgccucaaaagaauggcgaucucaggagacgacuguguagugaagcccauugaugaccgguuugccaccgcucuuacggcccugaaugauauggguaaggucaggaaagacauaccgcagugggagccuaguaagggcuggaacgauuggcagcaagugcccuucugcucucaccacuuucaucagcuaaucaugaaagacgggcgagagauuguugugccaugucguaaucaggaugaacuggucggcagagcacgcgugagccagggcgcugguuggucccuccgggagaccgccugcuuggggaagucauaugcacaaauguggcagcugauguacuuccacaggagagaccuucgccuggccgcgaacgcuaucuguagcgccguaccuguugauugggugcccacaucucggacuaccugguccauucaugcacaccaucaguggaugacaacugaagacaugcucagugucuggaauaggguguggaucgaugagaacccauggauggaagacaaaacccacauaagcucguggggagacguucccuauuuaggcaagcgagaggaucaauggugcggcucccugaucggguugacggccagagcuacaugggccaccaauauucagguggcaaucaaccagguccggaggcugauuggaaaugagaacuaccucgacuacaugacuucuaugaagcgcuuuaaaaaugaaucagauccugagggugcucuuugguga

SEQ ID NO: 13272 - RNA, 9879 nt, Artificial Sequence
  derived and/or modified CDS sequence (opt3) from DENV-1__GQ868639__SS-prME
agcgugaccaugcugcucaugcuuaugcccaccgcacuggcuuuccacuugacuacgagaggaggggaaccucauaugaucgucuccaagcaggaaagggggaaaucuuuacuguuuaagaccucagccgguguuaacaugugcacccugauugccauggaccucggagaguucugugaagauacuaugaccuacaaaugcccacggauaagugaagcggaaccggacgauguggacuguuggugcaaugcuacagauaccuggguaacuuaugggacauguagccaaaccggagagcaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuugccgacuuccaaucccaucagcugugggcaacuuugcucucacugaccuuuaucaaaacgacauucagccuacacuaugcuuggaagaccauggccauggugcugaguauugucucucuuuuuccccucugucuguccacuaccagccagaagacaacuugguugccgguacuguuaggcucgcucgggugcaaaccucugaccauguuccuuaucgccgagaauaagauauggggaagaaaaucauggccacugaacgaagguaucauggcugugggcauuguuucuaucuugcucaguucccugcuaaagaacgaugugccccuggcagggccucuuauugccggaggcaugcucaucgcguguuacgucauaagcgguucuagcgcugaccuguccuuggagaaagccgcagaggugucaugggaagaggaagccgagcauaguggggcuagccacaauauuuuaguagaagugcaggaugacggaacgaugaagaucaaagaugaggagagggacgauacacugaccauccuccugaaggcaacucuucuggccgucucuggcguuuaucccuuguccauuccagcgacacuauucgugugguacuuuuggcaaaagaaaaagcagcgaucaggcgugcugugggacaccccuagucccccagaagucgagcgcgcugugcucgaugacgggauauaucggaucaugcagagaggacugcuugguaggagccagguuggcguagggguguuccaagaaaacgucuuucauacuauguggcacgugacacguggagccguuuuaauguaccagggcaaacgccuggagccguccugggcaucugugaagaaagaccucauuucguacggugggggauggcgguugcagggcagcuggaauaccggcgaggaaguccaggugaucgccguagagccugggaagaaccccaagaauguccaaacggcuccaggaacuuucaaaaccucagaaggugaggugggcgccauugcacuggauuuuaagcccgggacauccggaaguccuaucguuaacagagaaggcaaaauagugggucucuaugggaauggagucgugaccacaucuggcacuuacguuagcgcuaucgcccaggcgaaggccucccaggagggcccacugcccgagauugaagacgagguguucaggaaacgaaaccuuaccaucauggaucugcacccugggucaggaaagacgcggcgcuauuugccggcaauugucagagaagcuaucaagaggaaacuacggacacugauacucgccccaacucgagugguagcuucugagauggcagaagccuuaaaggguaugcccauuagauaccaaaccacagccgugaaaagcgagcauaccggcaaggagaucguugaccugaugugccacgcuacuuuuaccaugcgccuucugaguccugucagggugccaaauuauaacaugaucauuauggaugaagcgcauuucacagaccccuccagcaucgcagcccguggguacauaucuacgcgggugggaaugggcgaggcugccgcaauuuuuaugacugccaccccuccggguucagcugaagcguucccccaguccaaugccgucauccaggaugaggaaagagacauuccagagaggaguuggaacagcggguaugaguggaucacagauuuuccuggaaaaaccguaugguucgugcccucgauaaagucuggcaaugacauugcaaacugucuccgcaagaauggcaaacgaguuauccaguuguccagaaagacuuucgauacagaauaccagaagaccaagaacaacgacugggacuacguggucacgacugauaucagcgagaugggggcuaauuuucgggccgacagggugauugauccacgccguugccugaaaccuguuauccucaaggacggacccgaaagagugauucuggcagguccaaugccggucacaguggccucagcugcccagcggaggggccgcauagggcgaaaccacaauaaggagggagaucaguauaucuacaugggccagccucuuaacaaugacgaggaucaugcgcacuggaccgaagcaaaaaugcuacuggacaacauuaauacccccgaggguaucaucccagccuuguucgaacccgagagagaaaagagugcugccauugauggggaguaucgguuaaggggcgaggcucgcaaaacuuuuguagaacugaugagaaggggagaccucccuguguggcugucuuacaagguugcauccgagggcuuccaauauagcgaucggcguuggugcuuugacggggaacgcaacaaucagguccuugaggaaaacauggauguggagauauggacaaaagagggagaacgaaagaaacugagaccaagguggcucgacgcccggaccuacucagaccccuuggcucugcgcgaguucaaggaauuugccgcagguagaaggagugugagcggcgaucuaauccuggagauugggaagcucccucagcaccuuacacagcgggcgcaaaaugcccuggacaacuuagucauguugcauaauuccgaacagggaggccgagcuuauagacacgccauggaggagcugccggauacuaucgaaacgcucaugcugcuugcacugauugcuguucucaccgguggggugacauuguucuuucugucuggccgcggauuaggcaaaacuagcaucgggcuacuguguguaauggccuccucagugcuccuuuggauggcaucugucgagccacauuggauagccgcuaguaucauucuggaguucuuuuugauggugcugcucauccccgagccugacaggcagcggacaccccaggauaaccaacuggcguacguugugauuggacuucucuucaugauccugacagucgccgcaaaugagauggguuugcuggaaaccacuaagaaagacuuaggcauagggcacguagcuguggagaaccaccaucacgccgccaugcuagauguugaccugcauccagcaucggcuuggacgcucuacgccguggcgaccacaauuaucacuccuaugaugcgucacaccauugaaaacacaaccgcuaauaucagccuuacugccauagcaaaccaggccgcuauccugaugggauuggauaagggcuggcccauuuccaaaauggacaucggugucccacugcucgcacuggggugcuauucucaggugaauccucuuacauuaacggccgcgguccugaugcucguggcucauuacgccauuaucggcccgggauugcaagcaaaggccaccagagaggcucagaagaggacugccgcaggcauaaugaaaaaccccacaguugaugggauuguggcuaucgaccuggauccaguaguguaugacgccaaguuugaaaaacagcuaggacagaucaugcugcucauucuuuguaccucacaaauccuguugaugcgcaccacaugggcgcugugcgagagcauaacucucgccacgggcccucugaccacauuaugggaggguucccccgggaaguucuggaauacuaccauugcagucaguauggcuaacaucuuccggggaucuuaccuugccggcgcaggucuggcuuuuagccucaugaaaucacuaggcgggggacgaagaggcacaggggcccagggagaaacccugggcgagaaguggaagaggcaguugaaucagcuguccaaaagugaguucaacacuuauaagcgcagcgguauuauggagguugaccggucugaagccaaagaggggcucaagagaggagagacgacaaaacacgcggugucccguggcaccgcuaaacuuaggugguuugucgaacggaaucuggugaagccagaggguaaaguaaucgauuugggcugugggcgcggaggcuggucauacuauugcgcagggcugaagaaagugacugaaguuaagggauacaccaaaggcgguccugggcacgaggaacccauaccgauggccacauacggauggaaccucgugaaguuacauagcggcaaagacgucuucuuugugccaccugagaagugugauacucugcuuugcgacaucggcgagucgucucccaauccaaccauugaagaggggcgaacacugagaguccuaaagaugguggaacccuggcucaggggaaaccaauucuguaucaaaauucugaauccuuauaugccgaguguuguagagacguuggagcagaugcagcggaagcacgguggcaugcuggugcgcaacccccucuccagaaauagcacccaugaaauguacugggucucaugcgggacuggaaacaucguguccgcuguuaauaugacaucuaggaugcuucugaaccgauuuaccauggcccaccggaaaccaacuuaugagcgugauguggacuuaggcgcagguacaagacacgucgccguggaaccugagguagcuaaccuggauauuaucgggcagcgcauagaaaauauuaagcaugagcacaaaagcaccuggcauuacgacgaggauaaccccuauaagacgugggcguaccacggaaguuaugaagugaagccuuccggcagcgccucuucaaugguuaauggcgucgugaaauugcucaccaagccaugggacgugauccccauggucacacaaaucgcaaugacugauaccacaccuuucgggcagcagaggguuuuuaaagagaagguggacacucggaccccaaaagcuaagagaggaacagcccaaauuauggaaguaaccgcaaaguggcugugggguuuccuaagucgcaacaaaaagcccaggauauguacucgagaggaauuuacgcggaaagugagauccaaugccgcuaucggcgccgucuucguggacgagaaccaguggaauagcgcgaaggaggcaguugaagaugagagguuuugggaccuugugcaucgcgaacgugagcugcacaaacaggggaagugcgccacaugcgucuacaacaugaugggaaagcgggagaaaaagcucggcgaguucgguaaagcuaaggggucuagagccauuugguacauguggcugggagcaagguucuuggaguuugaagcucugggcuucaugaaugaggaucacugguuuucgcgcgaaaacucacucagcggcguggagggggagggacuucauaaacuggguuauaucuuacgagacauuuccaagaucaguggcgggaauauguacgccgaugacaccgcuggaugggauacucggauaaccgaagacgaucugcagaacgaggccaaaaucacagacauuauggaaccggagcacgcauugcucgcgaagucuaucuucaagcugacguaucaaaauaaaguaguuagagugcagaggccugccaagaacggcaccgucauggaugugauuagccgcagagaccagcgggguuccggacaggugggaacuuacggccuaaauacauuuaccaacauggaagcucaacuuaucaggcagauggagucagagggcauauucaguccaucugaacuggagacucccaaccucgccgaacgugcacuggauugguuggagaaacauggggucgaacgauuaaagcgcauggcuauuagcggagacgacuguguugugaaaccuaucgaugacagauuugccacagcacugaccgcccucaaugauauggguaagguacggaaggacaucccacagugggagcccuccaaaggcuggaacgauuggcagcaagugccguucugcucacaccacuuucaucagcuuauuaugaaggacgggagggagauagucgugccuugucgcaaucaggaugaacugguuggcagagcgcgggugagccagggcgcugguuggucucuaagggagacagccugccuggggaaauccuaugcacaaauguggcagcucauguacuuccaccgacgugacuugagacuggccgcuaacgccaucuguagugcaguccccguggauuggguaccaacuagccgcaccacguggucgauucaugcucaccaucaguggaugaccacagaagacaugcuuuccguuuggaaucggguguggaucgaggaaaacccuuggauggaggauaagacucacauuucuucaugggaggacguccccuaucugggaaaaagggaagaccaauggugcggcagccucaucggcuuaaccgccagagcgacaugggcuacuaauauacagguggccaucaaccagguucgccggcugauugggaaugagaacuacuuggauuacaugaccaguaugaagagguuuaagaaugaauccgacccagagggagcacugugguga

SEQ ID NO: 13273 - RNA, 9879 nt, Artificial Sequence
  derived and/or modified CDS sequence (opt3) from DENV-1__GU131925__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccuggcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcuuaaguugagggauuccuauacacaggucugcgaccaccgucucaugucagcagccaucaaagauaguaaggcugugcacgccgacaugggguacuggauugaaucugagaaaaaugaaacguggaagcuggcacgggcgagcuucaucgagguuaagaccuguauauggccaaaaucccauacucuauggucaaacggagugcuggaaagcgagaugaucauucccaagaucuauggcgguccuauuucucaacacaauuaccgaccaggcuacuucacacagaccgccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggaaaaugcucaugaccgggacucuggccgucuuccuacugcucaucaugggacagcugacauggaacgaucuuauucguuugugcauaauggugggcgcaaaugcuucugacagaauggggaugggaaccacauaccuggccuuaauggcaacuuuuaagaugaggccuauguucgccguuggccuccuguuucgccggcuuaccagcagagaggugcugcuacucacgaucggucugucauuggucgcuaguguggaacugccaaacuccuuagaggaacucggggauggacuggcgaugggcauuaugauccuuaaacuguugacagacuuccaaucucaucagcucugggccacccugcuaagccugacuuuuauuaagaccacauucucccuucacuaugcauggaaaacuauggcuaugguucucucaaucgugagccuguuucccuugugucugaguaccacgucucagaagacaaccugguuaccgguccuccugggcucccuugggugcaagccucugacuauguucuugauagccgagaauaaaaucuggggaaggcgaagcuggccacucaacgaagguauuauggccguaggcaucgugucgauucugcuaucaucucugcuuaagaacgauguuccccucgcugggccucugaucgcaggaggcauguugauagccuguuacgugauuagugguuccagcgcggacuuaucucuggagaaagcugccgaggucagcugggaagaggaagcagagcauuccggggccucacacaauauccucguggaaguacaggaugacggaacaaugaagaucaaagaugaggagcgcgacgauacccugacuauucuucugaaggcuacauugcuagcagugaguggcgucuauccccugagcauaccagccacccucuuuguuugguacuucuggcagaagaagaagcagcggucuggcgugcugugggacacgccuucacccccagaaguggagagagcgguccuugaugacgggaucuauaggauuaugcagcguggauuacugggucgcagccaggugggcguugggguauuccaagaaaacguguuucauacuauguggcacgucacccggggagcugugcucauguaccagggcaaaagauuggagccgaguugggccagcguuaagaaagaccugaucuccuacggugggggauggaggcuccagggcucuuggaauacaggcgaggaagugcaggucauugcaguggagccugggaagaaccccaaaaauguacaaaccgccccaggaacauucaagacucccgaaggugaggucggcgcuaucgcccuggauuuuaagccugggaccucgggaagcccaauagugaaccgagaaggcaaaaucguuggucuuuaugggaauggaguggucacgacaucaggcacuuacguguccgcaauugcucaggccaaggcgagucaggagggcccccugccugagaucgaagacgagguuuuccggaaacgcaacuugaccauuauggaucuacacccggggucuggaaagacaagaagguaucugccagccaucgugcgggaagcaauaaaacgaaagcucagaaccuuaauucuggcucccacucgcgucguggccagcgagauggcugaagcacuuaaggguaugccuaucagguaccaaaccacagccguaaaauccgagcauacgggcaaggagaucguggaccugaugugccacgccacuuuuaccaugcgucucuugucaccaguucggguccccaauuauaacaugauuaucauggaugaagcucauuucacagacccuucuagcauagcggcaagaggguacauuaguaccagggugggaaugggcgaggccgcugccaucuuuaugacugcaacaccgcccgguuccguggaagccuucccacagagcaaugcugucauucaggaugaggaacgcgacaucccugagcgaucuuggaacucaggguaugaguggauaaccgauuuucccggaaaaacgguaugguucgugccauccauuaagaguggcaaugacaucgcgaacugucugaggaaaaauggcaagcggguuauccagcucagcaggaagacuuuugauacagaauaccagaaaaccaagaacaacgacugggacuacguggucaccacugauauuucggagaugggggccaauuuccgcgcagaccgugugaucgauccuagacggugccugaaacccguuauucuuaaggacggaccagaaagggugauacuagcugguccgaugccugucacaguggccucugcagcccagcgccgaggcagaaucgggcggaaccacaauaaagagggagaucaguauauuuacaugggccagccccugaacaaugacgaggaucaugcucacuggaccgaagccaagauguuguuagacaacaucaauacaccagaggguaucauucccgcgcuguucgaaccugagagggaaaaguccgcagccauagauggggaguaucgccucagaggcgaggcuaggaaaacuuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacgaaagagggagaaaggaagaaauugcggccccgcuggcuggacgcuagaaccuacucugacccucuagcacugagggaguucaaggaauuugccgcuggucggcgauccgugagcggcgaucucauucuugagaucgggaaacugccgcagcacuuaacacagagagcccaaaaugcauuggacaaccuggucaugcuccauaauucagaacagggaggccgcgcguauaggcacgccauggaggagcugccagauacuauugaaacccuuaugcugcucgcuuugaucgccguucugacagguggggugaccuuauucuuucuaaguggccggggacugggcaagacuagcauagggcuccuuuguguaauggcauccucugugcuguuguggauggcuagcgucgagccccauuggaucgccgcauccauuauccuggaguucuuucucauggugcugcuuauuccugagcccgaccgucagagaacgccacaggauaaccaacucgccuacguugugaucggacuguuguucaugauacugaccgucgcugcgaaugagauggguuuacuagaaacaacuaagaaagaccugggcauugggcacguagccgugggaaaccaccaucacgcagcuaugcucgauguugaccuucauccugccucagccuggacccuguacgcaguggcuacaaccaucauuacucccaugaugaggcacacaaucgagaacacgaccgccaauauaucuuugacugcgaucgcuaaccaggccgcaauucugaugggccucgauaaggguuggccaaucaguaaaauggacauuggggucccucugcuugccuuaggcugcuauucgcaagugaauccgcugacacucaccgcugcagucuugaugcugguggcccauuacgcgaucauaggacccggccuacaagcuaaggccacccgcgaagcacagaaacggacagccgcugggauuaugaagaacccaacuguugauggaaucguggccaucgaccuggauccuguaguguaugacgcaaaguuugagaaacagcucggccagauuaugcuucugaucuuguguacgagccaaauacugcucaugcgaaccacaugggcucugugcgaauccauuacuuuagccaccgguccccuuacaacccugugggaggggucuccaggaaaguucuggaauacuacgaucgcggucucaauggccaacauuuuuagaggcagcuaccucgcaggagcuggccuagccuucucccugaugaaaagucuagggggaggcaggcgcgggacaggagcacagggcgagacccugggugaaaaguggaaacggcagcucaaucagcuuucuaagagcgaguucaacacuuauaagagaucagggaucauggaaguugaccguuccgaggcuaaagaaggacugaagaggggcgagaccacaaaacacgccgugagucgggguacugccaaguugcgcugguuugucgagcgaaaucuggugaaaccugaaggcaagguaauagaucucggguguggaagaggcggguggagcuacuauugcgcgggauuaaagaaagugaccgagguuaagggcuacacaaaaggugggcccggacacgaagaaccgaucccaauggcuacguacggcuggaaccuggugaaacuucauucuggcaaagacgucuucuuuauuccucccgaaaagugugauacccugcuaugcgacaucggggaguccucaccaaaucccacuauugaggaaggaaggacacuccgggugcugaaaauggucgagccuugguugcgcgguaaccaauucuguaucaagauucugaauccguauaugcccagcgugguugaaacccucgagcagaugcagagaaagcacggcgggaugcuuguaaggaacccacugucgcgaaauucuacucaugagauguacugggugaguugcggaacaggcaacaucgucuccgcagugaauaugaccagccggauguuacugaaccguuuuacgauggcccacagaaaaccuaccuaugaacgcgauguugacuugggugcugggacaaggcacguggccgucgagcccgaaguggcaaaccucgauauaauuggacagcggaucgagaauaucaagcaugaacacaaaucaacuuggcauuacgacgaggauaacccuuauaagaccugggccuaccacggcuccuaugagguaaaaccaucuggcagcgcuaguuccauggugaaugggguugucaagcugcuaacaaagcccugggacgugauuccuauggugacucaaauagcgaugaccgauacaaccccauucggacagcagagagucuuuaaagaaaagguugacacucgcacgcccaaagccaagagggguacagcacaaaucauggaggugaccgcuaaauggcuuuggggcuuccugagccgaaacaagaagccgcggauuuguacuagagaagaguuuaccaggaaaguacgcucuaaugccgcaaucggggccguguucgucgacgaaaaccaguggaacucagcuaaggaggccguggaggaugaacguuuuugggaccucguucaucgggagagagaacugcacaaacagggaaagugcgcgacaugcguguacaacaugaugggcaaaagggagaagaaguugggugaguucgggaaagcaaagggaagucgcgccauuugguacauguggcugggcgcucgauuucucgaguucgaggcccuuggcuucaugaaugaagaucacugguuuucccgggagaacagccugucuggggucgaaggagaggguuuacauaaacugggcuauaucuugagagacauaucgaagaucccugggggaaauauguacgcagaugacacggcuggcugggauaccaggauuacugaggacgaucuccagaacgaagcccgcaucacagacauuauggagccagaacacgcucugcuagccaaaucaaucuucaaacuuaccuaucaaaauaaagugguaagaguucagcggcccgcaaagaacgguacugugauggaugucauaagcaggcgugaccagcgaggguccggacaggugggcacauacggccugaauaccuuuacaaacauggaggcgcaacucauucgccagauggaaagugaggggaucuucucuccuagcgagcuggaaacuccaaacuuggccgagagaguguuagauuggcuggaaaaguauggagucgagcggcucaaaaggauggcuaucuccggugacgacuguguugugaagcccauugaugaccgcuuugccaccgcacuuacggcucugaaugauaugggcaaaguaagaaaggacauaccgcagugggaaccuucaaaaggguggaacgauuggcagcaagugcccuucugcagucaucacuuucaccagcuaaucaugaaggacggacgggagauugucgugccauguaggaaucaggaugagcugguuggccgagcccgugugucucagggugcaggguggagccucagagaaaccgccugcuugggaaaguccuacgcgcaaauguggcagcugauguauuuccaucgccgggaccuuaggcuggcugccaacgcaaucuguucagccgucccuguggauuggauucccacaagcagaacuaccuggucuauccacgcucaucaccaguggaugacaacugaggacaugcucuccguauggaaucgcguuuggauagaagagaacccauggauggaagauaaaacccauaucaguagcuggggcgacgugcccuacuuaggcaagcgggaggaccaauggugcgggucgcugauuggauugacggccagggcaacaugggcuaccaauauccaggucgccauuaaccaggugcgaagacugaucgguaaugagaacuaccucgauuauaugacuuccaugaaacgguuuaagaaugaaucugacccugagggcgcgcuuugguga

SEQ ID NO: 13274 - RNA, 9879 nt, Artificial Sequence
  derived and/or modified CDS sequence (opt3) from DENV-1__GU131926__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaacaugugcacacuaauugccauggaccucggagaguucugugaagauacuaugaccuacaaaugcccacggauaagugaagcggaaccggacgauguggacuguuggugcaaugcuacagauaccuggguaacuuaugggacauguagccaaaccggagaacaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguugacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggaguuaauucccgaagcaccucucugucaaugacuuguauugcugucggcuuagugacacuguaccuaggggugaugguccaggccgauaguggaugcguuaucaacuggaaaggccgcgaacucaagugugguagcgggaucuuugugaccaaugaggugcacacauggacugaacaauauaaguuccaggcagacuccccgaaaagacugucugccgcuauuggaaaggccugggaggagggcguaugcgguauaaggucggcaacccggcuugaaaacaucauguggaaacagauuagcaacgaguugaaucauauccugcucgaaaacgacaugaaguuuacggucgugguuggcgauguggcugggauucuggcccagggcaaaaagaugauccgcccucaacccauggaguacaaauauuccuggaagucauggggcaaggcgaaaauaaucggggccgacguccagaauacaaccuucauuaucgauggaccaaacacuccugaaugucccgacgaucagagagcuuggaauauuugggagguggaggacuacggcuuugguaucuucaccacaaacauaugguuaaagcugagggauaguuauacucagguuugcgaccaccgucuuaugucugcagccauuaaagauagcaaggcugugcacgccgacaugggguacuggaucgaauccgagaaaaaugaaaccuggaaguuggcacgggcgucauucauugagguaaagacauguaucuggccaaaaagccauacgcucuggucuaacggaguccuggaauccgagaugauaauccccaagauuuauggcgguccuaucagucaacacaauuaccgaccaggcuacuuuacccagacugccgggccguggcaucuaggaaaacuggagcucgauuucgaccugugcgaaggcacaaccgugguggucgaugagcacugcgggaacagaggacccagccuuaggacuacaaccguuacgggcaagauuauccacgaaugguguugccgcucuuguacuuugccuccacugcgguuuaaaggugaggacgggugcugguauggaauggagauaagacccgugaaggaaaaggaggaaaauuuaguaaaauccauggugucagcuggcaguggugaggucgacagcuucucgcucggccugcuuuguauuuccaucaugaucgaagaggugaugaggucucgcuggagccgaaagaugcugaugaccgggacauuggccguauuuuuccuccugauuaugggacagcuaaccuggaacgaucugauccggcucugcauuauggugggcgcaaaugcuucagaccguauggggaugggaaugacuuaccuggcccuuauggcaacauuuaaaaugagaccuauguucgccgucggcuugcuguuuaggcgcuuaaccagucgggaggugcuccugcuuacaauaggucugucccuaguugcuucuguggaacucccaaacagccuggaggaauugggggauggacuggcgaugggcaucaugauuuuaaagcuccugacugacuuccaaucccaucagcuuugggccacccuguugucacucacguuuaucaaaacaaccuucagccugcacuaugcauggaagacuauggcuaugguccuaaguauuguaucucuguuuccccuuugucucuccaccacaagccagaagacuaccuggcugccgguguugcugggcucguuagggugcaaaccucucacgauguuccugaucgccgagaauaagauauggggaagaaaaucauggccacuuaacgaagguaucauggccguuggcauugugucuauccuguugaguucccuccugaagaacgaugucccccuagcugggccucugauugcaggaggcaugcuuaucgccuguuacgugauaagcgguucuagcgcggaccucucccuggagaaagcugccgagguaucaugggaagaggaagcagagcauaguggggccagccacaauauuuugguggaaguccaggaugacggaacaaugaagaucaaagaugaggagagggacgauaccuuaacuauccugcucaaggcuacacugcuugcaguuucuggcguguauccccuguccauuccagccaccuuguucgugugguacuuuuggcaaaagaaaaagcagcgaucaggcguccuaugggacacuccuagucccccagaaguggagcgcgcgguucuggaugacgggauauaucggaucaugcagagaggacuccuggguaggagccagguaggcgugggggucuuccaagaaaacguguuucauacaauguggcacguuacccguggagcugugcuuauguaccagggcaaacgcuuagagccguccugggccucugucaagaaagaccugauuucguacggugggggauggcggcuccagggcagcuggaauacgggcgaggaagugcagguaaucgcagucgagccugggaagaaccccaagaaugugcaaacugccccaggaaccuucaaaacaucagaaggugagguuggcgcuauugccuuggauuuuaagcccgggaccuccggaaguccuaucgugaacagagaaggcaaaauagucggucuguaugggaauggagugguuacaacuucuggcaccuacgugagcgcaaucgcucaggccaaggcgucccaggagggcccacuccccgagauugaagacgaggucuucaggaaacgaaaccugacgaucauggaucuucacccugggucaggaaagacacggcgcuaucugccggccauugugagagaagcaaucaagaggaaauugcggacucuaauacuggcuccaacccgaguaguggccucugagauggcugaagcacucaaggguaugcccauuagauaccaaacaaccgccguuaaaagcgagcauacuggcaaggagaucgucgacuuaaugugccacgccaccuuuacaaugcgccugcuuaguccugugagggugccaaauuauaacaugaucauuauggaugaagcucauuucacggaccccuccagcaucgcggcacguggguacauaucuacucgggucggaaugggcgaggccgcugccauuuuuaugaccgcaacaccuccggguucagccgaggcuuucccccaguccaaugcgguaauccaggaugaggaaagagacauuccagagaggaguuggaacagcggguaugaguggaucaccgauuuuccuggaaaaacugugugguucguucccucgauaaagucuggcaaugacauugccaacugucugcgcaagaauggcaaacgagugauccagcucuccagaaagacauucgauaccgaauaccagaaaacgaagaacaacgacugggacuacgucgugacuacagauaucagcgagaugggggcaaauuuucgggcugacaggguuauugauccacgccguugcuugaaaccugugauccugaaggacggacccgaaagagucauucucgccgguccaaugccggugaccguagcaucagccgcucagcggaggggccgcauagggcgaaaccacaauaaggagggagaucaguauaucuacaugggccagccucugaacaaugacgaggaucaugcccacuggaccgaagcgaaaaugcuucuagacaacauuaauacucccgaggguaucaucccagcacuguucgaacccgagagagaaaagagugccgcuauugauggggaguaucgguugaggggcgaggcccgcaaaacauuuguggaauuaaugagaaggggagaccugccuguuuggcucucuuacaaggucgcuuccgagggcuuccaauauagcgaucggcguuggugcuuugacggggaacgcaacaaucaggugcuggaggaaaacauggauguggagauauggaccaaagagggagaacgaaagaaacuuagaccaagguggcuggacgcacggacauacucagacccccucgccuugcgcgaguucaaggaauuugcugccgguagaaggagugucagcggcgaucugauccuagagauugggaagcugccucagcaccucacucagcgggcacaaaaugcgcuugacaaccugguuauguuacauaauuccgaacagggaggccgagccuauagacacgcuauggaggaguugccggauacgaucgaaacccugaugcuccuggcccuuauugcagugcugacaggugggguaacucucuucuuuuugucuggccgcggacugggcaaaaccagcaucggguuacuaugugugauggcuuccucaguccugcucuggauggccucuguggagccacauuggauagcagccaguaucauucuugaguucuuucugaugguuuugcugauccccgagccugacaggcagcggacaccccaggauaaccaacucgcuuacguggucauuggacugcuuuucaugauccucaccguagcggccaaugagaugggucuguuggaaacuacgaagaaagaccugggcauagggcacguggcaguugagaaccaccaucacgcugccauguuagauguggaccuacauccagccucggcauggacccuguacgcugucgccacaacuauuaucaccccuaugaugcgucacacaauugaaaacaccacugcgaauaucagccucacagcuauagccaaccaggcagccauccuuaugggacuggauaagggcuggcccauuuccaaaauggacaucggugugccauugcuggcucucgggugcuauucucaggucaauccucugacgcuuaccgcagccguguuaaugcugguugcgcauuacgcuauuaucggcccgggacuccaagccaaggcaacuagagaggcccagaagaggacagcugccggcauaaugaaaaaccccaccguggaugggauuguagcaaucgacuuggauccaguggucuaugacgcuaaguuugaaaaacagcugggacagaucaugcuacugauucucuguaccucacaaauccuucugaugcgcacaacuugggccuugugcgagagcauaacgcuggcgaccggcccucucacaacucugugggaggguucccccgggaaguucuggaauaccacaauugccguuaguauggcaaacaucuuccggggaucuuacuuagcuggcgccggucuugcauuuagccugaugaaaucacucggcgggggacgaagaggcaccggggcucagggagaaacucuaggcgagaaguggaagaggcagcugaaucaguuguccaaaagugaguucaacacguauaagcgcagcgguauuauggagguggaccggucugaagccaaagaggggcugaagagaggagagacaaccaaacacgccgucucccguggcacugcgaagcucaggugguuuguggaacggaaucuuguaaagccagaggguaaagugaucgaucugggcugugggcgcggaggcuggucauacuauugcgcuggguugaagaaaguuaccgaagugaagggauacacaaaaggcgguccugggcacgaggaacccauaccgauggcaacuuacggauggaaccuggucaagcuccauagcggcaaagacguguucuuugucccaccugagaagugugauaccuuacugugcgacaucggcgagucgucucccaauccaacaauugaagaggggcgaacgcuuagagugcugaagaugguugaacccuggcuaaggggaaaccaauucuguaucaaaauucucaauccuuauaugccgaguguaguggagacccuggagcagaugcagcggaagcacgguggcauguugguccgcaacccccuguccagaaauagcacucaugaaauguacugggugucaugcgggacaggaaacaucguuuccgccgugaauaugaccucuaggaugcuccuuaaccgauuuacuauggcucaccggaaaccaacauaugagcgugaugucgaccugggcgccgguaccagacacguggcaguagaaccugagguggccaacuuagauauuaucgggcagcgcauagaaaauauuaagcaugagcacaaaagcacguggcauuacgacgaggauaaccccuauaagaccugggcuuaccacggaaguuaugaaguuaagccuuccggcagcgcgucuucaauggucaauggcguggugaaacuguugacaaagccaugggacgucauccccaugguuacucaaaucgccaugaccgauacaacuccuuucgggcagcagaggguguuuaaagagaagguagacacccggacaccaaaagcaaagagaggaaccgcucaaauuauggaagugacugccaaguggcucugggguuuccugagucgcaacaaaaagcccaggauauguacgcgagaggaauuuacacggaaagucagauccaaugcagccaucggcgcuguguucguugacgagaaccaguggaauagcgccaaggaggcgguggaagaugagagguuuugggaccuaguccaucgcgaacgugagcuucacaaacaggggaagugcgcaaccugcguguacaacaugaugggaaagcgggagaaaaagcugggcgaguucgguaaagccaaggggucuagagcuauuugguacauguggcucggagccagguuccuggaguuugaagcauugggcuucaugaaugaggaucacugguuuucgcgcgaaaacucacugagcggcguagagggggagggacuccauaaacuugguuauauccugcgagacauuuccaagaucaguggcgggaauauguacgcugaugacacugccggaugggauacccggauaacagaagacgauuuacagaacgaggcuaaaaucacggacauuauggaaccggagcacgcccuguuggcaaagucuaucuucaagcucaccuaucaaaauaaaguugugagaguccagaggccugcgaagaacggcacugugauggaugugauuagccgcagagaccagcgggguuccgggcaggucggaacauacggccugaauaccuuuacuaacauggaagcccaacuaaucaggcagauggagucagagggcauauucaguccaucugaacuugagacacccaaccuggcugaacgugcccucgauuggcuggagaaacaugggguugaacgauugaagcgcauggcaauuagcggagacgacugugugguaaaaccuaucgaugacagauuugcuaccgccuuaacagcacugaaugauauggguaaggugcggaaggacaucccacagugggagcccuccaaaggcuggaacgauuggcagcaagucccguucugcucacaccacuuucaucagcucauuaugaaggacgggagggagauagugguuccuugucgcaaucaggaugaacuugugggcagagcacgggucagccagggcgcggguuggucucugagggagacugcuugccuagggaaauccuaugcccaaauguggcagcugauguacuuccaccgacgugaccucagauuggcagccaacgcuaucuguagugccgugcccguagauuggguuccaaccagccgcacgaccuggucgauucaugcacaccaucaguggaugacaacugaagacaugcuguccguguggaaucgggucuggaucgaggaaaacccuuggauggaggauaagacccacauuucuucaugggaggacgugcccuaucuuggaaaaagggaagaccaauggugcggcagccugaucggccucacagcuagagccacuugggcgaccaauauacagguugcuaucaaccaggugcgccgguuaauugggaaugagaacuaccuggauuacaugacgaguaugaagagguuuaagaaugaauccgacccagagggagccuugugguga

SEQ ID NO: 13275 - RNA, 9879 nt, Artificial Sequence
  derived and/or modified CDS sequence (opt3) from DENV-1__FJ639669__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuugcccagggcaaaaagaugauccgcccucaacccauggaguacaaauauucguggaaaagcuggggcaaggcgaaaauaaucggggccgacgugcagaauacuaccuucauuaucgauggaccaaacacaccugaaugucccgacgaucagagagcuuggaauauuugggaggucgaggacuacggcuuugguaucuucacuaccaacauaugguugaagcucagggauuccuauacacaggugugcgaccaccgucugaugucagcagccauuaaagauaguaaggcuguucacgccgacaugggguacuggaucgaaucugagaaaaaugaaacguggaagcuagcacgggcgagcuuuauugaggugaagaccuguaucuggccaaaaucccauacucuguggucaaacggaguacucgaaagcgagaugauaauccccaagauuuauggcgguccuaucucucaacacaauuaccgaccaggcuacuucacacagaccgccgggccguggcaucugggaaaacuugaguuggauuucgaccugugcgaaggcacuacagucgugguggaugagcacugcgggaacagaggacccuccuuaaggaccacgacugucaccggcaagauuauccacgaaugguguugccgcaguuguacacucccuccacugcgguuuagaggugaggacgggugcugguauggaauggagauaaggcccguuaaagaaaaggaggaaaaucuugugaaguccaugguaucugcuggcuccggugagguggacucauucagucugggcuugcucuguauuagcaucaugaucgaagaggucaugcgcucgcgauggucccggaaaaugcugaugaccgggacucuagccguguuuuuccugcucauuaugggacagcugacauggaacgaucuuauccguuugugcauuaugguuggcgcaaaugcuucugacagaauggggaugggaaccacauaccuggccuuaauggcaacuuuuaagaugaggccuauguucgccgugggccuccuguuucgccggcuuaccagcagagagguccugcuacucacgauaggucugucauugguggcuaguguugaacugccaaacuccuuagaggaacucggggauggacuggcgaugggcaucaugauucuuaaacuguugacagacuuccaaucucaucagcucugggccacccugcuaagccugacuuuuaucaagaccacauucucccuucacuaugcauggaaaacuauggcuauggugcucucaauugucagccuguuucccuugugucugaguaccacgucucagaagacaaccugguuaccgguacuccugggcucccuugggugcaagccucugacuauguucuugaucgccgagaauaaaauauggggaagaaagagcuggccacucaacgaagguaucauggccgugggcauuguuucgauccugcuaucaucucugcuuaaaaacgaugugccccucgcugggccucugauugcaggaggcauguugaucgccuguuacgucauaagugguuccagcgcggacuuaucucuggagaaggcugccgaggugagcugggaagaggaagcagagcauuccggggccucacacaauauucucguagaagugcaggaugacggaacaaugaaaaucaaggaugaggagcgagacgauacccugacuauccuucugaaagcuacauugcuagcagucaguggcguuuauccccugagcauuccagccacccucuuugugugguacuucuggcaaaagaagaaacagcgcucuggcgugcugugggacacgccuucacccccagaagucgagcgggcggugcuugaugacgggauauauagaaucaugcagaggggauuacugggucguagccagguuggcguagggguguuccaagaaaacgucuuucauacuauguggcacgugacccgcggagcuguucucauguaccagggcaagcgguuggagccgaguugggccagcgugaaaaaggaccugauuuccuacggugggggauggagacuccagggcucuuggaauacaggcgaggaaguccaggugaucgcaguagagccugggaaaaaccccaagaauguccaaaccgccccaggaacauucaagacucccgaaggugaggugggcgcuauugcccuggauuuuaaaccugggaccucgggaagcccaaucguuaacagggaaggcaagauagugggucuuuaugggaauggagucgugacgacaucaggcacuuacguuuccgcaaucgcucaggccaaagcgagucaggagggcccccugccugagauugaagacgagguguuccgaaagcggaacuugaccaucauggaucuacacccggggucuggaaaaacacgcagauaucugccagccauugucagggaagcaaucaagcggaagcuccgaaccuuaauacuggcucccacuagagugguagccagcgagauggcugaagcacuuaaagguaugccuauucgcuaccaaaccacagccgugaaguccgagcauacgggcaaagagaucguugaccugaugugccacgccacuuuuaccaugaggcucuugucaccaguccgugugcccaauuauaacaugaucauuauggaugaagcucauuucacagacccuucuagcaucgcggcacggggguacauaaguaccagagugggaaugggcgaggccgcugccauuuuuaugacugcaacaccgcccgguuccgucgaagccuucccacagagcaaugcuguaauccaggaugaggaaagggacauuccugagcgcucuuggaacucaggguaugaguggaucaccgauuuucccggaaagacggugugguucguuccauccauaaaaaguggcaaugacauugcgaacugucugcgaaagaauggcaagagagugauccagcucagccggaaaacuuuugauacagaauaccaaaagaccaaaaacaacgacugggacuacgucgugaccacugauaucucggagaugggggccaauuucagggcagaccgcguuauugauccucguagaugccugaagcccgugauccuuaaagacggaccagaacgggucauucuagcugguccgaugccugugacaguagccucugcagcccagaggcgcggccgaauagggagaaaccacaauaaggagggagaucaguauaucuacaugggccagccccugaacaaugacgaggaucaugcucacuggaccgaagccaagauguuguuagacaacauuaauacaccagaggguaucauccccgcgcuguucgaaccugagcgggaaaaauccgcagccauugauggggaguauaggcuccgcggcgaggcuagaaagacuuuuguggaacugaugaggcggggagaccuuccaguuuggcugagcuacaaagucgccucagagggcuuccaauauagugaucgucgcuggugcuuugacggggaacgaaacaaucaggugcucgaggaaaacauggauguggagauauggacgaaggagggagaaaggaaaaaguugaggccccgguggcuggacgcucgcaccuacucugacccucuagcacugagagaguucaaagaauuugccgcugguaggcgguccgucagcggcgaucucauccuugagauugggaagcugccgcagcacuuaacacagcgagcccaaaaugcauuggacaaccugguuaugcuccauaauucagaacagggaggcagagcguaucgccacgccauggaggagcugccagauacuaucgaaacccuuaugcugcucgcuuugauugccgugcugacaggugggguaaccuuauucuuucuaaguggcaggggacugggcaagacuagcaucgggcuccuuugugugauggcauccucuguccuguuguggauggcuagcguggagccccauuggauagccgcauccaucauucuggaguucuuucucaugguucugcuuaucccugagcccgaccggcagcguacgccacaggauaaccaacucgccuacguggucauuggacuguuguucaugauccugaccguagcugcgaaugagauggguuuacuagaaacaacuaaaaaggaccugggcauagggcacguggccguugagaaccaccaucacgcagcuaugcucgauguggaccuucauccugccucagccuggacccuguacgcagucgcuacaaccauuaucacucccaugaugagacacacaauugaaaacacgaccgccaauaucucuuugacugcgauagcuaaccaggccgcaauccugaugggacucgauaaaggcuggccaauuaguaagauggacaucggugugccucugcuugccuuagggugcuauucgcaggucaauccgcugacacucaccgcugcaguguugaugcugguugcccauuacgcgauuaucggccccggacuacaagcuaaagccaccagggaggcacagaagcgcacagccgcuggcauaaugaagaacccaacuguggaugggauuguagccaucgaccuggauccuguggucuaugacgcaaaauuugaaaagcagcucggacagaucaugcuucugauuuuguguacgagccaaauccugcucaugcggaccacaugggcucugugcgaguccauaacuuuagccaccggcccccuuacaacccugugggaggguucuccagggaaauucuggaauacuacgauugcgguuucaauggccaacaucuuucgaggaagcuaccucgcaggcgcuggucuagccuucucccugaugaagaguuugggcgggggaagaaggggcacaggggcacagggagaaacccugggcgagaaauggaagcgccagcucaaucagcuuucuaagagcgaguucaacacuuauaaacggucagguauuauggagguggacagauccgaagcuaaggaggggcugaaacguggagagaccacaaagcacgccgucaguaggggcacugccaaauugcggugguuuguggaacgcaaucugguaaagccugaggguaaggugaucgaucucggcugugggcgaggaggcuggagcuacuauugcgcggggcuaaagaagguuaccgaagugaaaggauacacaaagggcggucccgggcacgaggaaccgauaccaauggcuacguacggauggaaccuggucaaacuucauucuggcaaggacguguucuuuaucccucccgagaaaugugauacccugcuaugcgacauuggcgaguccucaccaaaucccacuaucgaagaggggagaacacucaggguccugaagaugguggaaccuugguugcggggaaaccaauucuguauuaagauccugaauccguauaugcccagcguuguagagacccucgagcagaugcagcgcaaacacgguggcaugcuugugagaaacccacugucgagaaauucuacucaugaaauguacugggucaguugcgggacaggaaacauuguguccgcaguuaauaugaccagccgaauguuacugaaccgguuuacgauggcccaccguaagccuaccuaugagagagauguggacuugggcacagguacucgccacgucgcuguggaacccgagguagccaaccucgauaucauagggcagaggauugaaaauaucaaacaugagcacaagucaaccuggcauuacgacgaggauaacccuuauaaaacaugggcauaccacggauccuaugaagugaagccaucuggcagcgccaguuccaugguuaauggcgucgugaagcugcuaacuaaacccugggacgugaucccuauggucacccaaauugcuaugacagauaccacuccauucgggcagcagcggguuuuuaaggagaaaguggacacgagaacacccaaggcgaaacgcggaaccgcccaaauaauggaaguaacugcaagguggcuuugggguuuccugagccgaaacaagaagccgcggaucuguaccagagaggaauuuacaaggaaagugcgcucuaaugcugccauuggcgcagucuucguggacgagaaccaguggaacucagccaaggaggcuguugaagaugagcguuuuugggaccucgugcaucgggaaagagagcugcacaaacaggggaagugcgccacgugcgucuacaacaugaugggaaaaagggaaaagaaguugggcgaguucgguaaagcgaaggggagucgcgcaaucugguacauguggcugggagcccgauuucucgaguucgaagcucuuggcuucaugaaugaggaucacugguuuucccgggaaaacagccugucuggcguggagggggagggauuacauaaacuggguuauauuuugagagacaucucgaagauaccuggcgggaauauguacgccgaugacaccgcaggaugggauacuaggaucacagaagacgaucuccagaacgaggcuaaaauuaccgacaucauggaaccagagcacgcccugcuagcuaaggccauuuucaaacuuacuuaucaaaauaagguaguucgcgugcagagacccgcaaagaacggcacagucauggaugugaucucacggagggaccagcgugguagcggacaggugggaaccuacggccugaauacauuuacuaacauggaagcgcaacucauacgacagauggaguccgagggcauuuucaguccuucugaacuggagaccccaaacuuggccgaacgcgcuuuagauuggcuggagaaauauggggucgaaagacucaagcggauggccaucagcggagacgacuguguugugaaacccaucgaugacagguuugcaacggcucuuaccgcccugaaugauauggguaagguacgcaaagacauuccgcagugggagccuuccaagggcuggaacgauuggcagcaagugcccuucugcucacaucacuuucaccagcuaauaaugaaggacgggagagagaucgucgugccaugucggaaucaggaugaacugguuggaagggcacgagugagucagggcgccgguuggucucuccgugagacagcgugcuuggggaaaagcuacgcucaaauguggcagcugauguauuuccauagacgcgaccuucggcuggccgcaaacgccauuuguuccgcugucccuguggauuggguacccacuucaaggaccacauggagcauccacgcccaucaccaguggaugacuaccgaagacaugcucucuguuuggaauagaguguggauugaggaaaacccauggauggaggauaagacgcauaucuccaguugggaggacguccccuacuuaggaaaacgcgaagaccaauggugcggcagccugauaggcuugacagcacgggcuaccugggccacuaauauccagguggcgauuaaccagguuaggcgacugaucgggaaugagaacuaccucgauuauaugacaucgaugaagagauuuaaaaaugaauccgacccugagggagcucuuugguga

SEQ ID NO: 13276 - RNA, 9882 nt, Artificial Sequence
  derived and/or modified CDS sequence (opt3) from DENV-1__FJ639670__SS-prME
agcgugaccaugcugcucaugcuuaugcccacagcacuggcuuuccacuugacuacgagaggaggggagccucauaugaucgucuccaagcaggaaaggggaaaaucuuuacuguuuaagaccucagccgguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuugcccagggcaagaagaugauccgcccucaacccauggaguacaaauauucguggaaaagcuggggcaaggcgaagauaaucggggccgacgcucagaauacuaccuucauuaucgauggaccaaacacaccugaaugucccgacgaucagagagcauggaauauuugggagguggaggacuacggcuuugguaucuucacuaccaacauaugguugaagcucagggauuccuauacacaggucugcgaccaccgucugaugucagccgcuauuaaagauaguaaggccgugcacgcagacaugggguacuggaucgaaucugagaaaaaugaaacguggaagcuagcgcgggccagcuuuauugagguuaagaccuguaucuggccaaaaucccauacucuguggucaaacggagugcucgaaagcgagaugauaauccccaagauuuauggcgguccuaucucucaacacaauuaccgaccaggcuacuucacacagaccgcugggccguggcaucugggaaaacuugaguuggauuucgaccugugcgaaggcacuacaguagucguggaugagcacugcgggaacagaggacccuccuuaaggaccacgacugugaccggcaagauuauccacgaaugguguugccgcaguuguacacucccuccacugcgguuuagaggugaggacgggugcugguauggaauggagauaaggcccgucaaagaaaaggaggaaaaucuuguuaagagcauggugucugccggcuccggugagguagacucauucagucugggcuugcucuguauuagcaucaugaucgaagaggugaugcgcucgcgauggucccggaaaaugcugaugaccgggacucuagcagucuuuuuccugcucauuaugggacagcugacauggaacgaucuuauccguuugugcauuauggugggcgcuaaugccucugacagaauggggaugggaaccacauaccuggcauuaauggccacuuuuaagaugaggccuauguucgcuguuggccuccuguuucgccggcuuaccagcagagaggugcugcuacucacgauaggucugucauuggucgcgaguguggaacugccaaacuccuuagaggaacucggggauggacuggccaugggcaucaugauucuuaaacuguugacagacuuccaaucucaucagcucugggcaacccugcuaagccugacuuuuaucaagaccacauucucccuucacuaugcuuggaaaacuauggccaugguucucucaauugugagccuguuucccuugugucugaguaccacgucucagaagacaaccugguuaccgguccuccugggcucccuugggugcaagccucugacuauguucuugaucgccgagaauaaaauauggggaagaaaguccuggccacucaacgaagguaucauggcuguaggcauugugucgauccugcuaucaucucugcuuaaaaacgauguuccccucgcagggccucugauugccggaggcauguugaucgcguguuacgugauaagugguuccagcgcugacuuaucucuggagaaggccgcagaggucagcugggaagaggaagccgagcauuccggggcuucacacaauauucucguggaaguacaggaugacggaacaaugaaaaucaaggaugaggagcgagacgauacccugacuauccuucugaaagcaacauugcuagccgugaguggcgucuauccccugagcauuccagcgacccucuuuguuugguacuucuggcaaaagaagaaacagcgcucuggcgugcugugggacacgccuucacccccagaaguggagcgggcuguccuugaugacgggauauauagaaucaugcagaggggauuacugggucguagccaggugggcguugggguauuccaagaaaacguguuucauacuauguggcacgucacccgcggagccgugcucauguaccagggcaagcgguuggagccgaguugggcaagcguuaaaaaggaccugauuuccuacggugggggauggagacuccagggcucuuggaauacaggcgaggaagugcaggucaucgccguggagccugggaaaaaccccaagaauguacaaaccgcuccaggaacauucaagacucccgaaggugaggucggcgccauugcacuggauuuuaaaccugggaccucgggaagcccaaucgugaacagggaaggcaagauaguuggucuuuaugggaauggaguggucacgacaucaggcacuuacguguccgcuaucgcccaggcgaaagccagucaggagggcccccugccugagauugaagacgagguuuuccgaaagcggaacuugaccaucauggaucuacacccggggucuggaaaaacacgcagauaucugccagcaauugugagggaagcuaucaagcggaagcuccgaaccuuaauacuggcccccacuagagucguggcuagcgagauggcagaagcccuuaaagguaugccuauucgcuaccaaaccacagccguaaaguccgagcauacgggcaaagagaucguggaccugaugugccacgcuacuuuuaccaugaggcucuugucaccaguucguguccccaauuauaacaugaucauuauggaugaagcgcauuucacagacccuucuagcaucgcagcccggggguacauaaguaccagagugggaaugggcgaggcugccgcaauuuuuaugacugccacaccgcccgguuccguggaggcuuucccacagagcaaugcggucauccaggaugaggaaagggacauuccugagcgcucuuggaacucaggguaugaguggaucaccgauuuucccggaaagacgguaugguucgugccauccauaaaaaguggcaaugacauugccaacugucugcgaaagaauggcaagagaguuauccagcucagccggaaaacuuuugauacagaauaccaaaagaccaaaaacaacgacugggacuacguggucaccacugauaucucggagaugggggcaaauuucagggcugaccgcgugauugauccucguagaugccugaagcccguuauccuuaaagacggaccagaacgggugauucuagccgguccgaugccugucacaguggcaucugccgcucagaggcgcggccgaauagggagaaaccacaauaaggagggagaucaguauaucuacaugggccagccccugaacaaugacgaggaucaugcccacuggaccgaagcgaagauguuguuagacaacauuaauacaccagaggguaucauccccgcacuguucgaaccugagcgggaaaaauccgccgcuauugauggggaguauaggcuccgcggcgaggccagaaagacuuuuguagaacugaugaggcggggagaccuuccaguguggcugagcuacaaaguugcuucagagggcuuccaauauagugaucgucgcuggugcuuugacggggaacgaaacaaucagguccucgaggaaaacauggauguggagauauggacgaaggagggagugucuaggaagaauuugaggccccgguggcuggacgcacgcaccuacuccgacccucuagcccugagagaguucaaggaguuugcugccgguaggcggagcgucucaggcgaucucauccuugaaauugggaaacugccgcagcacuuaacacagcgagcacaaaacgcguuggacaaucugguuaugcuccauaacagugagcagggaggcagagccuaucgccacgcuauggaagaacugccagauacuaucgagacccuuaugcugcucgccuugauugcagugcugacaggugggguaaccuuauucuuucuaagcggcaggggacugggcaagacuuccaucgggcuccuuugugugauggcuucuagcguccuguuguggauagccuccguggaaccccauuggaucgcagccucaauuauccuggaguucuuucucaugguucugcuuauuccugaacccgaccggcagcguacgccacaggauaaucaacucgcuuacguggucaucggacuguuguucaugauacugaccguagcggccaacgagauggguuuacuagagacaacuaagaaagaccugggcauugggcacguggcaguugaaaaccaccaucacgcugccaugcucgauguggaccuucauccugccucugcauggacccuguacgcugucgccacaaccaucauuacucccaugaugagacacacaaucgagaauacgaccgcgaacauaaguuugacugcuaucgccaaucaggcagccauucugaugggacucgauaagggcuggccaaucucgaaaauggacauuggugugccucugcuugcuuuagggugcuauagccaggucaacccgcugacacucaccgcagccguguugaugcugguugcgcauuacgcuaucauaggccccggacuacaagccaaggcaaccagggaagcccagaaacgcacagcugccggcauuaugaagaauccaacuguggaugggaucguagcaaucgaccuggauccuguggucuaugacgcuaaguuugagaaacagcucggacagauuaugcuucugaucuuguguacgucccaaauacugcucaugcggaccacaugggcccugugcgaaucuauuacuuuagcgaccggcccccuuacaacccugugggaggguucaccagggaaguucuggaacacuacgaucgccguuagcauggcaaauauuuuucgaggauccuaccucgcuggcgccggucuagcauucagucugaugaaaucuuugggcgggggaagaaggggcacaggggcucagggagagacccugggcgaaaaguggaaacgccagcucaaccagcuuagcaagucagaguucaauacuuauaagcgguccgguaucauggaaguggacagaagugaggccaaagaagggcugaagcguggagagaccacaaaacacgccgucagcaggggcacugcgaaguugcggugguuuguggagcgcaaccugguaaaaccugaagguaaggugauagaucucggcugugggcgaggaggcuggucuuacuauugcgcuggguuaaagaaaguuaccgaggugaagggauacacaaaaggcggucccgggcacgaagaaccgaucccaauggcaacguacggauggaaucuggucaaacuucauuccggcaaagacguguucuuuauuccucccgaaaagugugauacccugcuaugcgacaucggcgagucaagcucgaacccaacuauugaggaagggagaacacucaggguccugaaaaugguggagcccugguugcggggaaaucaauucuguaucaagauucugaacccuuauaugccgucuguuguagaaacccucgagcagaugcagcgcaagcacgguggcaugcuugugagaaauccccugaguaggaacuccacucaugagauguacugggucagcugcgggacaggaaauaucgugucagccguuaacaugaccucccgaauguuacugaaccgguuuacgauggcucaccguaaaccaaccuaugaaagagauguggacuugggcacagguacucgccacgucgccguggagccugaaguagcaaaucucgauauaauugggcagaggaucgagaacaucaagcaugaacacaaaucuaccuggcauuacgacgaggauaaucccuauaagacaugggccuaccacggaagcuaugaggugaaaccuaguggcuccgcuagcucuaugguuaacggcgucgugaagcugcuaacuaagccaugggacgugauucccauggucacccaaauagcgaugacagauaccacuccuuucgggcagcagcggguuuuuaaagaaaagguggacacgagaacaccaaaagccaagcgcggaaccgcacaaaucauggagguaacugcuagguggcuuugggguuuccugucacgaaauaaaaagccccggauuuguaccagagaagaguuuacaaggaaggugcgcaguaacgccgcaaucggcgccgucuucguggacgaaaaucaguggaacuccgcuaaagaggccguugaggaugaacguuuuugggaccucgugcaucgggagagagaacugcacaagcaggggaaaugcgcgacgugcgucuacaauaugaugggaaagagggagaaaaaguugggcgaguucgguaaggcaaaagggagccgcgccauuugguacauguggcugggagcucgauuucucgaguucgaggcccuuggcuucaugaacgaagaucacugguuuucucgggaaaauucgcugucaggcguggaaggggagggauuacauaagcuggguuauaucuugagagacauaagcaaaaucccgggcgggaacauguacgcagaugacaccgcuggaugggauacuaggauuacagaggacgaucuccagaaugaagccaagaucaccgacauuauggagccugaacacgcucugcuagccaaagcaaucuucaaacuuacuuaucaaaacaaaguaguucgcgugcagagaccagcgaagaauggcacagucauggaugugauaucccggagggaccagcgugguaguggacaggugggaaccuacggccugaacacauuuacuaacauggaggcccaacucauucgacagauggaaucugagggcaucuucagccccuccgagcuggaaaccccuaauuuggcugagcgcgccuuagauuggcuggaaaaguauggggucgagagacucaaacggauggcaaucucaggagacgacuguguugugaagccaauugaugacagguuugcuacggcccuuaccgcacugaacgauauggguaaaguacgcaaggacauaccccagugggaaccgaguaaaggcuggaaugauuggcagcaagugccuuucugcucucaucacuuucaccagcuaaucaugaaggacgggagagagauugucgugcccugucggaaccaggaugagcugguuggaagggcccgagugagccagggcgcggguuggucccuccgugaaacagcuugcuuggggaagucauacgcccaaauguggcagcugauguauuuccauagacgcgaccuucggcuggcagccaaugcuaucuguagcgccgucccaguggauuggguaccuacuucuaggaccacaugguccauucacgcacaucaccaguggaugacuaccgaggacaugcucaguguuuggaacagaguguggaucgaagagaaucccuggauggaagauaaaacgcauauaagcucgugggaggacgucccauacuuaggaaagcgcgaggaccaauggugcggcucccugaucggcuugacagcucgggccaccugggcgacuaacauucagguggcuaucaaucagguuaggcgacugauugggaacgaaaauuaccucgauuauaugacaucuaugaaaagauuuaagaacgagucagaccccgaaggagcccuuugguga

SEQ ID NO: 13277 - RNA, 9879 nt, Artificial Sequence
  derived and/or modified CDS sequence (opt3) from DENV-1__FJ639671__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacucuuaccuacaaaugcccacggauaacagagguggaaccggacgauguagacuguuggugcaauaccacugauacaugggugaccuaugggacguguagucaaacuggagagcaccgccgagacaagcguagcgucgcgcuggcuccccaugugggcuugggucucgagaccagagccgaaacauggauguccucugagggggcauggaaacagauccagaggguugaaacuugggcccugcggcacccuggauucaccgugauugcucuguuucucgcacaugccaucggcacaucgauuacccagaagggcaucauauucaucuuacugaugcuugucacgccaucaauggcuaugcgcugcguggggauuggaagcagagauuuuguagaggguuugaguggcgccacuuggguugacgugguccuggagcacggguccugugugacaaccauggcgaaggauaaacccacucuagacaucgaacuccugaagacagaggugaccaacccugcaguccuuaggaaacugugcauugaagccaagaucucuaauacgaccacagauagccgguguccaacucaaggagaggcuaccuugguugaagagcaggacgccaacuucgugugccgccgaacauuuguagauagaggcugggguaauggguguggacucuucggcaaaggcucccugauaacuugcgcaaaguuuaagugcgugaccaaauuagaggggaagauuguccaguacgaaaaccugaaauauucagugaucguuacagugcacaccggagaccagcaucaagucgguaaugagaguacugaacacggcacgacagcuaccauuacuccccaggccccuaccagcgagauccagcucacagacuacggggcgcuuacccuggauuguucuccaaggacuggauuggacuucaacgaaauggugcuacugacaaugaaggagaaauccuggcucguacauaagcagugguuucuggaucuuccgcugcccuggacgucaggcgccagcaccagucaagagacuuggaaucggcaggacuugcucguuacauucaaaaccgcacacgcuaagaagcaggaaguggucgugcuggguucucaagagggggccaugcacacagcuuuaacuggcgccaccgaaauccagacguccggaaccacaacuauuuuugcaggccaucugaaaugccgucuaaagauggauaaacucacccugaaggggaugagcuaugucauguguacaggaucguucaaacuugagaaggaaguggccgagacucagcacgguaccguuuuggugcagauaaaguacgagggcacggacgcuccuugcaaaaucccauucucuacacaagaugggaagggaguaacccagaacggccgccugauuacugcgaaucccaucgucacagacaaagaaaagccugugaacauagaggcagaaccacccuuuggugaguccuauauuguuaucggggccggcgagaaagcucucaagcugucaugguucaagaaaggaaguagcaucggcaagauguuugaagccaccgcaagaggggccaggcggauggcuauucuuggagauacugccugggacuucgguuccgugggcggggucuuuaccucugugggaaaacugguacaucagaucuucggcacagcauacgguguguuguuuagcgggguuucauggacgaugaagauuggcauaggaguccuccugaccugguuaggccugaauagucgauccacuagccuaucuaugacauguaucgcgguggggcucgugacccuguaccuuggagucaugguucaggcugauucaggcugcgugauuaacuggaaaggucgcgaguugaagugugggaguggaaucuucgugacaaaugaaguacacacuuggaccgagcaauauaaguuucaggccgacagcccgaaaagacuguccgcagccaucggcaaggcuugggaagagggugucugcggcauuaggucugccacgcggcucgagaacgugauguggcgccagauaucgaacgaacugaaucauaucuuacuggagaacgacaugaaauucacaguuguggucggggaugugguuggaauucuugcacagggcaagaaaaugaucagaccucaacccauggaacacaaguacagcuggaaauccugggggaaggcuaagauuaucggagccgacgugcagaauaccacuuuuauaaucgauggcccaaacaccucagaguguccugacgaucagagggcguggaauauuugggaaguagaggacuaugguuucgggaucuuuacaacuaacauuugguugaaacuccgugauaguuacacccaggucugcgaccaccggcugaugucugccgcuaucaaggauagccgagcagugcaugccgacaugggauauuggauagaguccgaaaaaaaugagacauggaagcuagcuagagccucauucauugaagugaaaacguguaucuggcccaagagccacacccuguggucuaacggcguccucgaguccgaaaugauuaucccaaagauauacgguggccccaucagucaacauaauuauaggccuggguacuucacucagacagcaggaccauggcaccugggcaaacuugaguuggauuuugaccugugcgaggggaccacuguugugguagaugaacacugcggaaaccgcggcccgagcuuacggacaaccacggugacugguaagauuauccaugagugguguugcagaucuuguacccuccccccucugagguucaaaggggaagacggaugcugguacggcauggagauucgcccagucaaggagaaagaagagaaucuugugaaguccaugguuucagcggguaguggcgaaguggacagcuuuucgcugggguugcucuguaucuccauaaugauugaggaagucaugcgaucucgguggagccguaagaugcugaugacaggaacccuagccguguucuuucugcucaucaugggccagcugacuuggaacgaucuuaucagauugugcauuaugguuggggcuaaugccucagacaggaugggaaugggcacaaccuaucuggcauuaauggcuacauucaaaaugcgccccauguuugccgugggucuccuguuccggagacuuacuaguagggagguccugcuacucaccaucgggcuguccuugguagcaucuguggagcugccuaacagcuuagaagagcucggagauggccuggccaugggcauuaugauacuuaagcuguugacggacuuucaauccuaccagcucugggcuacacugcuaucacugaccuucaucaaaacuaccuuuagccuucacuaugcguggaagacaauggccaugguucucaguauugugucucuguugccacuguguuuauccacuaccagccagaaaacgacauggcuccccguccugcuugggucgcugggaugcaagccguugaccauguuccucaucgcagaaaauaagauuuggggucgaaaaucauggccucugaacgagggcaucauggcuguggggauaguaucuauccuacugaguucccuucucaagaacgaugugccacuggccggacccuugauugccggcgguauguuaaucgcuuguuacgucauuagcgggucuagcgcagaccugucccucgaaaaagccgcggagguuucaugggaggaagaggcugaacauaguggagccagccacaauauccugguggaggugcaggaugacggcacuaugaagauaaaagaugaagagcgcgacgauacacuuaccauucuguugaaggcaacucuacuggccgucucuggcguguauccucucuccauccccgcuacacuguuuguuugguacuucuggcaaaaaaagaagcagcggucagggguacuuugggacaccccaaguccucccgagguggaaagagcagucuuagaugacggaaucuauaggauuaugcagcguggucugcucggccgcagccagguggggguuggaguguuccaagagaacgucuuucauacgauguggcacgugacucggggcgccguauugauguaccaggguaaaagacuggaaccauccugggcgucugucaagaaagaccucauaucguacgggggaggcuggaggcugcagggcagcuggaauaccggggaggaggugcagguuaucgcuguggaaccgggaaagaacccuaaaaauguccaaacagcccccgguaccuucaagacaccagagggcgaagugggggcaauugcccuugauuuuaagcccggaacuucaggcuccccuaucguuaaccgagaggguaaaauuguggggcuguauggaaauggcgucgugaccacgaguggcacauacguaucugcuaucgcccaggcaaaggcuagccaggaagggccauugcccgagauagaggacgaaguguuccggaaacgcaaccuaacuaucauggaucugcacccuggauccgguaagaccagaagguaucucccggccauuguucgggaggcgaucaaacgaaaguuaagaacacugauucuugccccaacccgcgucguggcaucagaaauggcugaggcccugaagggcaugcccaucagguaccaaacuaccgcugugaaaucugaacauacagggcgugagauagucgaccucaugugccacgcaacguuuacuaugcgguugcugagcccuguaagagugccaaauuauaacaugauuaucauggaugaggcccauuucaccgaccccaguuccaucgccgcuaggggauacauuagcacacgcguuggcaugggugaagcggcagccaucuuuaugaccgcuacuccuccggggucuguggaggccuucccccagucaaaugcagucauacaggaugaagagcgagacauuccagaaagauccuggaacaguggauaugaguggaucacagauuuuccuggcaagaccgugugguucguucccagcauuaaaucgggcaaugacaucgccaacugucuccggaagaaugggaaaagggugauacagcugucucgcaagacguuugauacugaguaccaaaagacaaaaaacaacgacugggacuacgucgugaccaccgauauuuccgaaaugggagcuaauuuccgugcggacagaguaaucgauccacggaggugccuuaagccugugauccuaaaagacggucccgagcgcguuauucuggccggcccaaugccggucacuguggcaagcgcugcccagcgaagagggcggaucggaaggaaccacaauaaggaaggcgaucaguauauuuacaugggucagccuuugaacaaugacgaggaucaugcacacuggacagaggccaaaauguuacuggacaacauaaauacccccgaagggaucauuccagcucucuucgagcccgaacgcgagaagucagccgcgaucgauggcgaauauagacugaggggagaggcacggaagacauuuguggagcuuaugcgucgcggcgaccugccugucuggcucaguuacaaaguugccucugaaggguuccaauauuccgaucgaagauggugcuuugacggagagaggaacaaucagguguuggaagagaacauggauguagaaaucuggacuaaggagggugagcggaaaaagcugcgcccaagauggcuagacgcuaggacguacagcgacccccuggcccuccgggaauucaaagaguuugcugcaggccgaagaucagugaguggggaucuuauucuggaaauaggaaaguuaccucagcacuugacccagcgcgcccaaaaugcucuggacaaccucgucaugcugcauaauagcgagcagggcgguagggccuaucggcacgcaauggaagagcuuccggagacaaucgaaacucugaugcucuuggcgcugauugccguguuaaccgggggcguuacacuauucuuucuguccggacguggccucgggaaaaccucuaucggacuucugugugugauggcuagcuccgccuugcuguggauggcaucagucgagccacauuggauugcugccucuaucauacucgaauucuuucugaugguacuucucauccccgagccugauagacagaggacuccccaggacaaccaacuggcauacgugguuauugguuugcuguucaugaucuuaacgguggccgcuaaugagaugggccuacuggaaaccacaaagaaggaucucgggauuggacacgucgcgguggagaaccaccaucacgccacuaugcuugacgucgaucugcauccagcaagugcuuggaccuuguacgccguggccacaaccaucauaacuccuaugaugcgccacacaauugaaaacacgaccgcaaauaucucgcugacugcuauugccaaccaggcggcuauccucaugggccuggacaaagguuggcccauaagcaagauggauaucgggguuccacuuuuagcccugggcugcuauucccaggugaauccucucacauugaccgcagccguacugaugcuaguggcucauuacgcaauuaucggaccgggccugcaagccaaagcgacccgggaggcucagaagcgaacagccgcagggauuaugaaaaaccccacugucgacggaaucguugccauagaucucgacccaguggucuaugaugcuaaguuugaaaagcagcuuggccagauuaugcuguugauccuguguacgucucaaauccuccugaugagaaccacaugggccuuaugcgagucaauuacucuugcaaccgguccucugacaacccucugggaggggagccccggaaaauucuggaauacuacgaucgcuguguccauggccaacauauuuaggggcaguuaccuagcgggugccggccuggcauucucuuugaugaagagccuggggggaggccgccgggggacaggagcucagggcgaaacccucggugagaaauggaagagacagcuuaaucagcugucaaaauccgaauucaacacuuauaagcguagugggauuauggagguagacaggagcgaagccaaggagggauugcggcgcggcgagaccacaaaacacgcagugucucgagguacugcuaagcugagaugguuuguugaaaggaaucucgugaaaccagagggcaaggucaucgacuuaggguguggacggggcgggugguccuacuauugcgccggacugaaaaaggugaccgaagucaagggcuacacaaaaggugggccuggacacgaggaacccauuccgauggccacguacggcuggaaccuugugaagcugcauucaggcaaagauguuuucuuuaucccaccugagaagugugacacccuacucugcgauauaggggagagcucgcccaauccaacuaucgaagagggacgcacacugagaguauugaaaaugguggaacccuggcugagggguaaccaauucuguauuaagauccucaauccuuauaugccgucugucguggagacccuugagcagaugcagcgaaaacacggcgggaugcugguucggaaccccuuaagucguaauuccacucaugaaauguacugggugagcugcggaacaggcaacauugucucagcggugaauaugaccuccagaaugcuguugaaccgcuuuacgauggcucacaggaagccaaccuaugagcgggacguagaucucggugcagggacaagacacguggccguugaaccugaggucgcuaaccuggacaucauuggacagcgcaucgaaaauauaaagcaugagcacaaaucuacuuggcauuacgaugaggacaaccccuauaagaccugggccuaccacggcagcuaugaagugaaaccuaguggcuccgcaagcucuauggugaauggggucguuaagcuacuuacaaaaccaugggaugugauucccaugguaacucaaaucgccaugaccgacacaaccccuuucggacagcagaggguguuuaaggagaaggucgauacucgaacgccaaaagcuaagcgggguacagcgcaaaucauggaagugaccgccagauggcuguggggcuuccucucaaggaacaaaaagccccgcauuuguacucgugaggaauuuacccggaaaguuagaaguaaugcagcuauaggggccguguucgucgacgagaaccaguggaauuccgcaaaggaggccguggaagacgagagguuuugggaucugguacaucgcgaacgagaguugcacaagcagggaaaaugcgcuacaugcguuuacaacaugaugggcaagcgggaaaaaaagcugggugaguucgggaaagccaagggaagcagagcgaucugguacauguggcucggcgcaagguuucuugaguucgaagcccugggcuucaugaaugaggaccacugguuuucucgcgaaaacucguuaucagggguggagggagagggucugcauaaguugggcuauauucucagagauaucagcaaaauuccggggggaaauauguacgcugacgauacggccggcugggacacccggaucacugaagaugaccugcagaacgaggcaaagauaacagauaucauggaaccugagcacgcucuacuugccaccuccauuuucaaacugacuuaucaaaauaaggucgugagggugcagcguccagcuaaaaacgguacagucauggacguuaucagucgacgcgaucagagagggucuggacaggugggcaccuacggccucaauacauuuacuaacauggaagcccaacugauucggcagauggagagcgaggggaucuucucccccucagaauuggagaccccuaacuuagcagaaaggguacuggacuggcucgagaaguauggaguggaacgccuuaaaagaauggcgauaaguggugaugacugugucgugaagccaauugacgaucgguuugccacggcucugaccgcccuaaaugacaugggcaagguuaggaaagauaucccccagugggagccgucuaagggguggaacgacuggcagcaagugccuuucugcagccaucacuuucaccagcugaucaugaaagauggacgagagauugucgugcccugucguaaucaggacgaacucguaggcagagcacgcguuucccagggugcuggguggucauugcgggagacagccugccugggaaagagcuacgcacaaauguggcagcuuauguauuuccauaggagagaucugcgccucgccgcgaacgcuauauguucugccgugccagucgacugggugccuacuucccggaccacauggaguauccacgcacaucaccaguggaugacuaccgaagauauguuaagcguuuggaauaggguguggauugaggaaaaccccuggauggaggacaaaacgcauaucucguccuggggcgaugucccauaccugggcaagcgagaggaccaauggugcgggucuuugauuggacugacagccagagcuaccugggccacuaauauccagguggcaauaaaccagguacggaggcucaucgguaaugaaaacuaccuugacuauaugacaucaaugaagcgcuuuaaaaaugagagcgaucccgaaggcgcucugugguga

SEQ ID NO: 13278 - RNA, 9879 nt, Artificial Sequence
  derived and/or modified CDS sequence (opt3) from DENV-1__JN819423__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacucuuaccuacaaaugcccacggauaacagagguggaaccggacgauguagacuguuggugcaauaccacugauacaugggugaccuaugggacguguagucaaacuggagagcaccgccgagacaagcguagcgucgcgcuggcuccccaugugggcuugggucucgagaccagagccgaaacauggauguccucugagggggcauggaaacagauccagaggguugaaacuugggcccugcggcacccuggauucaccgugauugcucuguuucucgcacaugccaucggcacaucgauuacccagaagggcaucauauucaucuuacugaugcuugucacgccaucaauggcuaugcgcugcguggggauuggaagcagagauuuuguagaggguuugaguggcgccacuuggguugacgugguccuggagcacggguccugugugacaaccauggcgaaggauaaacccacucuagacaucgaacuccugaagacagaggugaccaacccugcaguccuuaggaaacugugcauugaagccaagaucucuaauacgaccacagauagccgguguccaacucaaggagaggcuaccuugguugaagagcaggacgccaacuucgugugccgccgaacauuuguagauagaggcugggguaauggguguggacucuucggcaaaggcucccugauaacuugcgcaaaguuuaagugcgugaccaaauuagaggggaagauuguccaguacgaaaaccugaaauauucagugaucguuacagugcacaccggagaccagcaucaagucgguaaugagaguacugaacacggcacgacagcuaccauuacuccccaggccccuaccagcgagauccagcucacagacuacggggcgcuuacccuggauuguucuccaaggacuggauuggacuucaacgaaauggugcuacugacaaugaaggagaaauccuggcucguacauaagcagugguuucuggaucuuccgcugcccuggacgucaggcgccagcaccagucaagagacuuggaaucggcaggacuugcucguuacauucaaaaccgcacacgcuaagaagcaggaaguggucgugcuggguucucaagagggggccaugcacacagcuuuaacuggcgccaccgaaauccagacguccggaaccacaacuauuuuugcaggccaucugaaaugccgucuaaagauggauaaacucacccugaaggggaugagcuaugucauguguacaggaucguucaaacuugagaaggaaguggccgagacucagcacgguaccguuuuggugcagauaaaguacgagggcacggacgcuccuugcaaaaucccauucucuacacaagaugggaagggaguaacccagaacggccgccugauuacugcgaaucccaucgucacagacaaagaaaagccugugaacauagaggcagaaccacccuuuggugaguccuauauuguuaucggggccggcgagaaagcucucaagcugucaugguucaagaaaggaaguagcaucggcaagauguuugaagccaccgcaagaggggccaggcggauggcuauucuuggagauacugccugggacuucgguuccgugggcggggucuuuaccucugugggaaaacugguacaucagaucuucggcacagcauacgguguguuguuuagcgggguuucauggacgaugaagauuggcauaggaguccuccugaccugguuaggccugaauagucgauccacuagccuaucuaugacauguaucgcgguggggcucgugacccuguaccuuggagucaugguucaggcugauucaggcugcgugauuaacuggaaaggucgcgaguugaagugugggaguggaaucuucgugacaaaugaaguacacacuuggaccgagcaauauaaguuucaggccgacagcccgaaaagacuguccgcagccaucggcaaggcuugggaagagggugucugcggcauuaggucugccacgcggcucgagaacgugauguggcgccagauaucgaacgaacugaaucauaucuuacuggagaacgacaugaaauucacaguuguggucggggaugugguuggaauucuugcacagggcaagaaaaugaucagaccucaacccauggaacacaaguacagcuggaaauccugggggaaggcuaagauuaucggagccgacgugcagaauaccacuuuuauaaucgauggcccaaacaccucagaguguccugacgaucagagggcguggaauauuugggaaguagaggacuaugguuucgggaucuuuacaacuaacauuugguugaaacuccgugauaguuacacccaggucugcgaccaccggcugaugucugccgcuaucaaggauagccgagcagugcaugccgacaugggauauuggauagaguccgaaaaaaaugagacauggaagcuagcuagagccucauucauugaagugaaaacguguaucuggcccaagagccacacccuguggucuaacggcguccucgaguccgaaaugauuaucccaaagauauacgguggccccaucagucaacauaauuauaggccuggguacuucacucagacagcaggaccauggcaccugggcaaacuugaguuggauuuugaccugugcgaggggaccacuguugugguagaugaacacugcggaaaccgcggcccgagcuuacggacaaccacggugacugguaagauuauccaugagugguguugcagaucuuguacccuccccccucugagguucaaaggggaagacggaugcugguacggcauggagauucgcccagucaaggagaaagaagagaaucuugugaaguccaugguuucagcggguaguggcgaaguggacagcuuuucgcugggguugcucuguaucuccauaaugauugaggaagucaugcgaucucgguggagccguaagaugcugaugacaggaacccuagccguguucuuucugcucaucaugggccagcugacuuggaacgaucuuaucagauugugcauuaugguuggggcuaaugccucagacaggaugggaaugggcacaaccuaucuggcauuaauggcuacauucaaaaugcgccccauguuugccgugggucuccuguuccggagacuuacuaguagggagguccugcuacucaccaucgggcuguccuugguagcaucuguggagcugccuaacagcuuagaagagcucggagauggccuggccaugggcauuaugauacuuaagcuguugacggacuuucaauccuaccagcucugggcuacacugcuaucacugaccuucaucaaaacuaccuuuagccuucacuaugcguggaagacaauggccaugguucucaguauugugucucuguugccacuguguuuauccacuaccagccagaaaacgacauggcuccccguccugcuugggucgcugggaugcaagccguugaccauguuccucaucgcagaaaauaagauuuggggucgaaaaucauggccucugaacgagggcaucauggcuguggggauaguaucuauccuacugaguucccuucucaagaacgaugugccacuggccggacccuugauugccggcgguauguuaaucgcuuguuacgucauuagcgggucuagcgcagaccugucccucgaaaaagccgcggagguuucaugggaggaagaggcugaacauaguggagccagccacaauauccugguggaggugcaggaugacggcacuaugaagauaaaagaugaagagcgcgacgauacacuuaccauucuguugaaggcaacucuacuggccgucucuggcguguauccucucuccauccccgcuacacuguuuguuugguacuucuggcaaaaaaagaagcagcggucagggguacuuugggacaccccaaguccucccgagguggaaagagcagucuuagaugacggaaucuauaggauuaugcagcguggucugcucggccgcagccagguggggguuggaguguuccaagagaacgucuuucauacgauguggcacgugacucggggcgccguauugauguaccaggguaaaagacuggaaccauccugggcgucugucaagaaagaccucauaucguacgggggaggcuggaggcugcagggcagcuggaauaccggggaggaggugcagguuaucgcuguggaaccgggaaagaacccuaaaaauguccaaacagcccccgguaccuucaagacaccagagggcgaagugggggcaauugcccuugauuuuaagcccggaacuucaggcuccccuaucguuaaccgagaggguaaaauuguggggcuguauggaaauggcgucgugaccacgaguggcacauacguaucugcuaucgcccaggcaaaggcuagccaggaagggccauugcccgagauagaggacgaaguguuccggaaacgcaaccuaacuaucauggaucugcacccuggauccgguaagaccagaagguaucucccggccauuguucgggaggcgaucaaacgaaaguuaagaacacugauucuugccccaacccgcgucguggcaucagaaauggcugaggcccugaagggcaugcccaucagguaccaaacuaccgcugugaaaucugaacauacagggcgugagauagucgaccucaugugccacgcaacguuuacuaugcgguugcugagcccuguaagagugccaaauuauaacaugauuaucauggaugaggcccauuucaccgaccccaguuccaucgccgcuaggggauacauuagcacacgcguuggcaugggugaagcggcagccaucuuuaugaccgcuacuccuccggggucuguggaggccuucccccagucaaaugcagucauacaggaugaagagcgagacauuccagaaagauccuggaacaguggauaugaguggaucacagauuuuccuggcaagaccgugugguucguucccagcauuaaaucgggcaaugacaucgccaacugucuccggaagaaugggaaaagggugauacagcugucucgcaagacguuugauacugaguaccaaaagacaaaaaacaacgacugggacuacgucgugaccaccgauauuuccgaaaugggagcuaauuuccgugcggacagaguaaucgauccacggaggugccuuaagccugugauccuaaaagacggucccgagcgcguuauucuggccggcccaaugccggucacuguggcaagcgcugcccagcgaagagggcggaucggaaggaaccacaauaaggaaggcgaucaguauauuuacaugggucagccuuugaacaaugacgaggaucaugcacacuggacagaggccaaaauguuacuggacaacauaaauacccccgaagggaucauuccagcucucuucgagcccgaacgcgagaagucagccgcgaucgauggcgaauauagacugaggggagaggcacggaagacauuuguggagcuuaugcgucgcggcgaccugccugucuggcucaguuacaaaguugccucugaaggguuccaauauuccgaucgaagauggugcuuugacggagagaggaacaaucagguguuggaagagaacauggauguagaaaucuggacuaaggagggugagcggaaaaagcugcgcccaagauggcuagacgcuaggacguacagcgacccccuggcccuccgggaauucaaagaguuugcugcaggccgaagaucagugaguggggaucuuauucuggaaauaggaaaguuaccucagcacuugacccagcgcgcccaaaaugcucuggacaaccucgucaugcugcauaauagcgagcagggcgguagggccuaucggcacgcaauggaagagcuuccggagacaaucgaaacucugaugcucuuggcgcugauugccguguuaaccgggggcguuacacuauucuuucuguccggacguggccucgggaaaaccucuaucggacuucugugugugauggcuagcuccgccuugcuguggauggcaucagucgagccacauuggauugcugccucuaucauacucgaauucuuucugaugguacuucucauccccgagccugauagacagaggacuccccaggacaaccaacuggcauacgugguuauugguuugcuguucaugaucuuaacgguggccgcuaaugagaugggccuacuggaaaccacaaagaaggaucucgggauuggacacgucgcgguggagaaccaccaucacgccacuaugcuugacgucgaucugcauccagcaagugcuuggaccuuguacgccguggccacaaccaucauaacuccuaugaugcgccacacaauugaaaacacgaccgcaaauaucucgcugacugcuauugccaaccaggcggcuauccucaugggccuggacaaagguuggcccauaagcaagauggauaucgggguuccacuuuuagcccugggcugcuauucccaggugaauccucucacauugaccgcagccguacugaugcuaguggcucauuacgcaauuaucggaccgggccugcaagccaaagcgacccgggaggcucagaagcgaacagccgcagggauuaugaaaaaccccacugucgacggaaucguugccauagaucucgacccaguggucuaugaugcuaaguuugaaaagcagcuuggccagauuaugcuguugauccuguguacgucucaaauccuccugaugagaaccacaugggccuuaugcgagucaauuacucuugcaaccgguccucugacaacccucugggaggggagccccggaaaauucuggaauacuacgaucgcuguguccauggccaacauauuuaggggcaguuaccuagcgggugccggccuggcauucucuuugaugaagagccuggggggaggccgccgggggacaggagcucagggcgaaacccucggugagaaauggaagagacagcuuaaucagcugucaaaauccgaauucaacacuuauaagcguagugggauuauggagguagacaggagcgaagccaaggagggauugcggcgcggcgagaccacaaaacacgcagugucucgagguacugcuaagcugagaugguuuguugaaaggaaucucgugaaaccagagggcaaggucaucgacuuaggguguggacggggcgggugguccuacuauugcgccggacugaaaaaggugaccgaagucaagggcuacacaaaaggugggccuggacacgaggaacccauuccgauggccacguacggcuggaaccuugugaagcugcauucaggcaaagauguuuucuuuaucccaccugagaagugugacacccuacucugcgauauaggggagagcucgcccaauccaacuaucgaagagggacgcacacugagaguauugaaaaugguggaacccuggcugagggguaaccaauucuguauuaagauccucaauccuuauaugccgucugucguggagacccuugagcagaugcagcgaaaacacggcgggaugcugguucggaaccccuuaagucguaauuccacucaugaaauguacugggugagcugcggaacaggcaacauugucucagcggugaauaugaccuccagaaugcuguugaaccgcuuuacgauggcucacaggaagccaaccuaugagcgggacguagaucucggugcagggacaagacacguggccguugaaccugaggucgcuaaccuggacaucauuggacagcgcaucgaaaauauaaagcaugagcacaaaucuacuuggcauuacgaugaggacaaccccuauaagaccugggccuaccacggcagcuaugaagugaaaccuaguggcuccgcaagcucuauggugaauggggucguuaagcuacuuacaaaaccaugggaugugauucccaugguaacucaaaucgccaugaccgacacaaccccuuucggacagcagaggguguuuaaggagaaggucgauacucgaacgccaaaagcuaagcgggguacagcgcaaaucauggaagugaccgccagauggcuguggggcuuccucucaaggaacaaaaagccccgcauuuguacucgugaggaauuuacccggaaaguuagaaguaaugcagcuauaggggccguguucgucgacgagaaccaguggaauuccgcaaaggaggccguggaagacgagagguuuugggaucugguacaucgcgaacgagaguugcacaagcagggaaaaugcgcuacaugcguuuacaacaugaugggcaagcgggaaaaaaagcugggugaguucgggaaagccaagggaagcagagcgaucugguacauguggcucggcgcaagguuucuugaguucgaagcccugggcuucaugaaugaggaccacugguuuucucgcgaaaacucguuaucagggguggagggagagggucugcauaaguugggcuauauucucagagauaucagcaaaauuccggggggaaauauguacgcugacgauacggccggcugggacacccggaucacugaagaugaccugcagaacgaggcaaagauaacagauaucauggaaccugagcacgcucuacuugccaccuccauuuucaaacugacuuaucaaaauaaggucgugagggugcagcguccagcuaaaaacgguacagucauggacguuaucagucgacgcgaucagagagggucuggacaggugggcaccuacggccucaauacauuuacuaacauggaagcccaacugauucggcagauggagagcgaggggaucuucucccccucagaauuggagaccccuaacuuagcagaaaggguacuggacuggcucgagaaguauggaguggaacgccuuaaaagaauggcgauaaguggugaugacugugucgugaagccaauugacgaucgguuugccacggcucugaccgcccuaaaugacaugggcaagguuaggaaagauaucccccagugggagccgucuaagggguggaacgacuggcagcaagugccuuucugcagccaucacuuucaccagcugaucaugaaagauggacgagagauugucgugcccugucguaaucaggacgaacucguaggcagagcacgcguuucccagggugcuggguggucauugcgggagacagccugccugggaaagagcuacgcacaaauguggcagcuuauguauuuccauaggagagaucugcgccucgccgcgaacgcuauauguucugccgugccagucgacugggugccuacuucccggaccacauggaguauccacgcacaucagcaauggaugacuaccgaagauauguuaagcguuuggaauaggguguggauugaggaaaaccccuggauggaggacaaaacgcacaucucguccuggggcgaugucccauaccugggcaagcgagaggaccaguggugcgggucuuugauuggacugacagccagagcuaccugggccacuaauauccagguggcaauaaaccagguacggaggcucaucgguaaugaaaacuaccuugacuauaugacaucaaugaagcgcuuuaaaaaugagagcgaucccgaaggcgcucugugguga

SEQ ID NO: 13279 - RNA, 9879 nt, Artificial Sequence
  derived and/or modified CDS sequence (opt3) from DENV-1__FJ639672__SS-prME
agcgugaccaugcugcucaugcuuaugcccacugcacuggcuuuccacuugacuacgagaggaggggaaccucauaugaucgucuccaagcaggaaagaggaaaaucuuuacuguuuaagaccucagccgguguuaacaugugcacacuaauugccauggaccucggagaacugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuagcaguagagauuuuguggagggacuuuccggugcgacuuggguagacguuguguuggagcacggcucuugugucacaaccauggcaaaggauaaacccacucuggacaucgaacuacucaagacagaggugaccaacccugccgugcugaggaaacuuugcauugaagcuaagaucagcaauacgaccacagauucccgguguccaacucaaggggaggccacccuggucgaagaacaggacgcaaacuucguuugccgccgaacauuuguggauagaggauggggcaaugguuguggguuguucggaaaaggcucacucauaacuugcgcuaaguuuaagugcguaaccaaacuggagggcaagauugugcaguacgaaaacuuaaaauauagugucaucgugacaguucacaccggggaccagcaucaagugggaaaugagagcacugaacacgguacgacagccaccauuacuccccaggcgccuaccacagagauccagcugaccgacuacggcgcccucacucuugauuguucuccaaggacagggcuggacuucaacgaaauggucuugcuaacgaugaaggagaaauccuggcuggugcauaagcagugguuucucgaucugccgcuucccuggaccucaggagcaagcacaagucaagagacauggaaucggcaggaccuguugguaaccuucaaaacagcucacgccaagaagcaggaaguugugguccucggcucucaagagggugcuaugcacacugcccugaccggggcaacggaaauccagaccuccggcacaacuaccauuuuugccggacauuuaaaaugccgucugaagauggauaaacuaacacucaagggcaugagcuaugugauguguacugggucguucaaacuggagaaggaagucgcugagacccagcacggaacggugcuuguucagauaaaguacgaggguacagacgcgccuugcaaaaucccauucucuacccaagaugaaaagggcgugacucagaacgggcgcuugauuacagcaaaucccaucguaaccgacaaagagaagccugucaacauagaagccgagccacccuuuggagaguccuauauugugaucggcgcuggugaaaaagcccugaagcucucaugguucaagaaagggaguagcaucggcaagauguuugaggcaacugccagaggagcuaggcggauggccauucugggcgauaccgcaugggacuucggguccaucggagguguuuuuacaucugugggcaaacuuguccaucagauuuucgggacggcguacggagugcuguuuagcggcguaucauggaccaugaagauagguaucgggguguugcucacuuggcugggcuuaaauagucgauccacaagccugucuaugaccuguauugcuguuggcuuagucacacucuaccugggcgugauggugcaggccgauucagggugcgucaucaacuggaaaggacgcgaacuuaaguguggcagugguaucuucguuacuaaugaggugcacaccuggacggaacaauauaaguuucaggcagacagcccgaaaagauuguccgccgcuauugggaaggccugggaggagggagugugcggcauaaggucugcaacacggcuggaaaacaucauguggaaacagauuucgaacgagcucaaucauauccuguuagaaaacgacaugaagcugaccguagucgugggugauguugcuggcauucuugcccaggggaaaaagaugauccgcccucaacccauggaguacaaauauagcuggaaguccuggggaaaggcgaaaauaaucggcgccgacgugcagaauacuaccuucauuaucgaugggccaaacacaccugaaugucccgacgaucagagagcuuggaauauuugggaggucgaggacuacggauuuggcaucuucacuaccaacauaugguugaagcucagggauucauauacacaggugugcgaccaccgucugaugagugcagccauuaaagauucuaaggcuguucacgccgacauggguuacuggaucgaaagcgagaaaaaugaaacguggaagcuagcacgggcguccuuuauugaggugaagaccuguaucuggccaaaaucacauacucuguggagcaacgggguacucgaaucugagaugauaauccccaagauuuauggaggcccuaucucccaacacaauuaccgaccagguuacuucacacagaccgccggcccguggcaucuggggaaacuugaguuggauuucgaccugugcgaaggaacuacagucgugguggaugagcacugcggcaacagagggcccaguuuaaggaccacgacugucaccggaaagauuauccacgaaugguguugccgcagcuguacacucccuccacugcgguuuagaggcgaggacgguugcugguaugggauggagauaaggcccguuaaagaaaaggaggaaaaucuugugaagucuaugguauccgcuggaucaggcgagguggacaguuucagccuggguuugcucuguauuucgaucaugaucgaagaggucaugcgcucccgauggucucggaaaaugcugaugaccggcacucuagccguguuuuuccugcucauuauggggcagcugacauggaacgaucuuauccguuugugcauuaugguuggagcaaaugcuagcgacagaaugggcauggggaccacauaccuggccuuaauggcaacuuuuaagaugaggccuauguucgccgugggacuccuguuucgccggcuuaccucaagagagguccugcuacucacgauaggccugaguuugguggcuuccguugaacugccaaacucuuuagaggaacucggugaugggcuggcgaugggaaucaugauucuuaaacuguugacagacuuccaaagccaucagcucugggccacccugcuaucccugacuuuuaucaagaccacauucucacuucacuaugcauggaaaacuauggcuauggugcucagcauugucagucuguuucccuugugucugucuaccacgucccagaagacaaccugguuaccgguacuccugggcagccuuggcugcaagccucugacuauguucuugaucgccgagaauaaaauaugggggaggaagucguggccacucaacgaaggaaucauggccguggguauuguuucaauccugcuaucuagucugcuuaaaaacgaugugccccucgcuggcccucugauugcagggggaauguugaucgccuguuacgucauauccggcagcucugcggacuuaagccuggagaaggcugccgagguguccugggaagaggaagcagagcauucaggugccagucacaauauucucguagaagugcaggaugacgggacaaugaaaaucaaggaugaggagcgagacgauacccugacuauccuucugaaagcuacauugcuagcagucagcggaguuuauccccugucuauuccagccacccucuuugugugguacuucuggcaaaagaagaaacagcgcuccggcgugcugugggacacgccuucacccccagaagucgagcgggcggugcuugaugacggcauauauagaaucaugcagaggggguuacugggacguagucagguugguguaggcguguuccaagaaaacgucuuucauacuauguggcacgugacccgcggggcuguucucauguaccagggaaagcgguuggagccgagcugggccuccgugaaaaaggaccugauuucuuacggcgguggguggagacuccagggaucguggaauacaggcgaggaaguccaggugaucgcaguagagccuggcaaaaaccccaagaauguccaaaccgccccagggacauucaagacucccgaaggagaggugggugcuauugcccuggauuuuaaaccuggcaccagcgggucaccaaucguuaacagggaaggaaagauagugggccuuuaugguaauggggucgugacgacauccggaacuuacguuagugcaaucgcucaggccaaagcgucucaggagggcccccugccugagauugaagacgagguguuccgaaagcggaacuugaccaucauggaucuacacccgggcagcgggaaaacacgcagauaucugccagccauugucagggaagcaaucaagcggaagcuccgaaccuuaauacuggcucccacuagagugguagccuccgagauggcugaagcacuuaaaggaaugccuauucgcuaccaaaccacagccgugaagucagagcauacggguaaagagaucguugaccugaugugccacgccacuuuuaccaugaggcucuugucuccaguccgugugcccaauuauaacaugaucauuauggaugaagcucauuucacagacccuagcaguaucgcggcacggggcuacauauccaccagaguggggaugggagaggccgcugccauuuuuaugacugcaacaccgcccggcagcgucgaagccuucccacagucuaaugcuguaauccaggaugaggaaagggacauuccugagcgcucauggaacuccgguuaugaguggaucaccgauuuucccgggaagacggugugguucguuccaaguauaaaaagcggaaaugacauugcgaacugucugcgaaagaauggcaagagagugauccagcucucgcggaaaacuuuugauacagaauaccaaaagaccaaaaacaacgacugggacuacgucgugaccacugauaucucugagaugggcgccaauuucagggcagaccgcguuauugauccucguagaugccugaagcccgugauccuuaaagacgggccagaacgggucauucuagcuggaccgaugccugugacaguagccuccgcagcccagaggcgcggucgaauaggcagaaaccacaauaaggagggggaucaguauaucuacaugggacagccccugaacaaugacgaggaucaugcucacuggaccgaagccaagauguuguuagacaacauuaauacaccagagggcaucauccccgcgcuguucgaaccugagcgggagaaaagcgcagccauugauggugaguauaggcuccgcggggaggcuagaaagacuuuuguggaacugaugaggcggggcgaccuuccaguuuggcugucauacaaagucgccagugagggauuccaauauucugaucgucgcuggugcuuugacggcgaacgaaacaaucaggugcucgaggaaaacauggauguggagauauggacgaaggagggggaaaggaaaaaguugaggccccgguggcuggacgcucgcaccuacuccgacccucuagcacugagagaguucaaagaauuugccgcuggaaggcggagcgucucaggugaucucauccuugagauuggcaagcugccgcagcacuuaacacagcgagcccaaaaugcauuggacaaccugguuaugcuccauaauagugaacaagggggcagagcguaucgccacgccauggaggagcugccagauacuaucgaaacccuuaugcugcucgcuuugauugccgugcugacaggcgguguaaccuuauucuuucuaagcgggaggggccugggaaagacuuccaucggccuccuuugugugauggcaucuagcguccuguuguggauggcuuccguggagccccauuggauagccgcaucaaucauucuggaguucuuucucaugguucugcuuaucccugagcccgaccggcagcguacgccacaggauaaccaacucgccuacguggucauugggcuguuguucaugauccugaccguagcugcgaaugagaugggauuacuagaaacaacuaaaaaggaccuggguauaggccacguggccguugagaaccaccaucacgcagcuaugcucgauguggaccuucauccugccucugccuggacccuguacgcagucgcuacaaccauuaucacucccaugaugagacacacaauugaaaacacgaccgccaauaucaguuugacugcgauagcuaaccaggccgcaauccugauggggcucgauaaaggauggccaauuucgaagauggacaucggcgugccucugcuugccuuagguugcuauagccaggucaauccgcugacacucaccgcugcaguguugaugcugguugcccauuacgcgauuaucgggcccggccuacaagcuaaagccaccagggaggcacagaagcgcacagccgcuggaauaaugaagaacccaacuguggauggcauuguagccaucgaccuggauccuguggucuaugacgcaaaauuugaaaagcagcucgggcagaucaugcuucugauuuuguguacgucccaaauccugcucaugcggaccacaugggcucugugcgagucuauaacuuuagccaccggaccccuuacaacccugugggagggcucaccagguaaauucuggaauacuacgauugcgguuagcauggccaacaucuuucgaggguccuaccucgcaggagcuggccuagccuucagucugaugaagucuuuggguggcgggagaaggggaacaggcgcacagggggaaacccugggagagaaauggaagcgccagcucaaucagcuuagcaagucagaguucaacacuuauaaacgguccggcauuauggagguggacagaagugaagcuaaggagggucugaaacguggggagaccacaaagcacgccgucagcaggggaacugccaaauugcggugguuuguggaacgcaaucugguaaagccugagggcaaggugaucgaucucgguuguggccgagggggauggucuuacuauugcgcgggccugaaaaagguuaccgaagugaaaggguacacaaagggaggccccggucacgaggaaccgauaccaauggcuacguacggguggaaccuagucaaacuucauuccggaaaggacgcauucuuuaucccucccgagaaaugugauacccugcuaugcgacauuggcgagucaagcccaaaucccacuaucgaagagggcagaacacucagggugcugaagauggucgaaccuugguugcgggggaaccaauucuguauuaagauccugaauccguauaugcccucggugguugagacccucgagcagaugcagcgcaaacacggagguaugcuuguaagaaacccacugucuaggaauaguacucaugaaauguacuggguguccugcggcacagggaacauugucagcgccgugaauaugaccucacgaauguuacugaaccgguuuacgauggcucaccguaagccuaccuaugagagagauguugacuugggaacaggcacucgccacguggccgucgaacccgagguggcaaaccucgauaucauaggucagaggauugaaaauaucaaacaugagcacaaguccaccuggcauuacgacgaggauaacccuuauaaaacaugggccuaccacgggucuuaugaaguaaagccaagcggaagugcuuccagcauggugaauggcguugucaagcugcuaacuaaacccugggacgugaucccuauggugacccaaauugcgaugacagauaccacuccauucggccagcagcgggucuuuaaggagaaaguugacacgagaacacccaaggccaaacgcgggaccgcacaaauaauggaagugacugcuagguggcuuuggggauuccugucucgaaacaagaagccgcggaucuguaccagagaggaauuuacaaggaaaguacgcucaaaugccgcaauuggugccguguucgucgacgagaaccaguggaauagugcuaaggaggccguggaagaugagcguuuuugggaccucguucaucgggaaagagagcugcacaaacagggcaagugcgcgacgugcguguacaacaugauggggaaaagggaaaagaaguugggagaguucggcaaagcaaaggguucccgcgccaucugguacauguggcugggggcucgauuucucgaguucgaagcccuuggauucaugaaugaggaucacugguuuagccgggaaaacucucugucgggcgucgagggcgagggguuacauaaacugggauauauuuugagagacaucucaaagauaccugguggcaauauguacgcagaugacaccgcugggugggauacuaggaucacagaagacgaucuccagaacgaggccaaaauuaccgacaucauggaaccagagcacgcucugcuagccaaggcaauuuucaaacuuacuuaucaaaauaaggugguacgcguucagagacccgcgaagaacggaacagugauggaugucaucagccggagggaccagcguggcuccggucagguggggaccuacggacugaauacauuuacuaacauggaagcccaacucauacgacagauggagagugagggcauuuucucuccuagcgaacuggagaccccaaacuuggcugaacgcgccuuagauuggcuggagaaauauggcguggaaagacucaagcggauggcaaucuccggggacgacugugucguuaaacccaucgaugacagguuugcuacggcccuuaccgcacugaaugauaugggaaaggugcgcaaagacauuccgcagugggagccuucaaaggguuggaacgauuggcagcaaguacccuucugcagucaucacuuucaccagcuaauaaugaaggacggcagagagaucguggucccaugucggaaucaggaugaacugguggggagggcccgaguuucucagggagcgggcuggagccuccgugagacagcuugcuuggguaaauccuacgcccaaauguggcagcugauguauuuccauagacgcgaccuucggcuggcagccaacgcuauuuguucagccgugccugucgauugggugcccacuagcaggaccacauggucuauccacgcacaucaccaguggaugacuaccgaagacaugcucuccguauggaauagaguuuggauugaggaaaacccauggauggaggauaagacgcauaucaguagcugggaggacgugcccuacuuagggaaacgcgaagaccaauggugcggaucgcugauaggcuugacagcucgggccaccugggcgacuaauauccaggucgcuauuaaccaggugaggcgacugaucggcaaugagaacuaccucgauuauaugacauccaugaagagauuuaaaaaugaaucugacccugagggggcccuuugguga

SEQ ID NO: 13280 - RNA, 9879 nt, Artificial Sequence
  derived and/or modified CDS sequence (opt3) from DENV-1__FJ639673__SS-prME
agcgugaccaugcugcucaugcuuaugcccacagcacuggcuuuccacuugacuacgcggggcggggagccucauaugaucguauccaagcaggaaagaggaaaaucuuuacuguuuaagaccucagccgguguuaauaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaggguugaaacuugggcccuccggcacccuggauucaccgugauugcucuguuucuggcacaugccaucggcacaucgauuacccagaagggcaucauauucauccucuuaaugcuggucacgccaucaauggcuaugcgcugcguggggauuggaagcagagauuuuguagagggucuuaguggcgccacuuggguugacguggucuuggagcacggguccugugugacaaccauggcgaaggauaaacccacucuggacaucgaacuacucaagacagaggugaccaacccugcaguccugaggaaacuuugcauugaagccaagaucucuaauacgaccacagauagccgguguccaacucaaggagaggcuacccugguugaagaacaggacgccaacuucgugugccgccgaacauuuguagauagaggcugggguaauggguguggauuguucggcaaaggcucccucauaacuugcgcaaaguuuaagugcgugaccaaacuggaggggaagauuguccaguacgaaaacuuaaaauauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaaggacuggacuggacuucaacgaaaugguguugcuaacaaugaaggagaaauccuggcugguacauaagcagugguuucucgaucugccgcuucccuggacgucaggcgccagcaccagucaagagacuuggaaucggcaggaccuguugguuacauucaaaaccgcacacgcuaagaagcaggaaguggucgugcucgguucucaagagggggccaugcacacagcucugacuggcgccaccgaaauccagacguccggaaccacaacuauuuuugcaggccauuuaaaaugccgucugaagauggauaaacuaacccucaaggggaugagcuaugucauguguacaggaucguucaaacuggagaaggaaguggccgagacucagcacgguaccguucuugugcagauaaaguacgagggcacggacgcuccuugcaaaaucccauucucuacacaagaugaaaaggggguaacccagaacggacgcuugauuacugcgaaucccaucgucacagacaaagagaagccugugaacauagaagcagagccacccuuuggcgaguccuauauuguuaucggugccggggaaaaagcucugaagcucucaugguucaagaaaggcaguagcaucggaaagauguuugaggccaccgcaagaggcgccaggcggauggcuauucugggggauacugccugggacuucggauccaucgguggcguguuuaccucugucgggaaacuugugcaucagauuuucggaacagcauacggcguacuguuuagcggugugucauggacgaugaagauagggaucggcguuuugcucaccuggcugggauuaaauagucgauccacuagccugucuaugacauguauugcggucggccuagugacccucuaccugggggugaugguccaggcugauucaggaugcguuaucaacuggaaaggccgcgaacuuaagugugguagugggaucuucgugacaaaugaggugcacacuuggaccgaacaauauaaguuucaggccgacagcccgaaaagauuguccgcagccauuggaaaggcuugggaggagggcguaugcgguauaaggucugccacgcggcuggaaaacaucauguggcgccagauuucgaacgagcucaaucauauccuguuagaaaacgacaugaaauucacagucgugguuggcgauguggucgggauucuggcacagggaaagaaaaugaucagaccucaacccauggagcacaaguacagcuggaaauccuggggcaaggcuaagauaaucggggccgacgugcagaauaccacuuuuauuaucgauggaccaaacaccccugaaugucccgacgaucagagggcguggaauauuugggagguugaggacuauggcuucgguaucuuuacaacuaacauauggcuuaaauugcgugauucauacacccaggugugcgaccaccggcucaugagugccgcuauuaaggauucuaaagcaguacaugccgacaugggguauuggaucgaaagcgagaagaaugaaacauggaaacuggcucgagccuccuucauugaggucaagacguguaucuggccaaagucacacacccuauggagcaacggagugcuggaaucugagaugauaauccccaaaauuuacggcgguccuaucucccaacauaauuauagaccaggcuacuucacucagacagcagggccguggcaccucggaaagcuggagcuugauuuugacuugugcgaaggcaccacuguggucguugaugagcacugcgggaacaggggacccagucugcgcacaaccacggugacuggcaaaauuauccaugaaugguguugccggagcuguaccuuaccuccacucagauucaagggugaggacgggugcugguacggaauggagauaaggcccguaaaagaaaaggaggaaaaucuggugaagucuauggucuccgcgggcucaggugagguggacaguuuuagccuuggccuguuguguauuucgaucaugaucgaagagguuaugcgcucccgauggucucggaaaaugcucaugacagggacccuggccguguucuuucuacugauuaugggacagcucacuuggaacgaucugauccguagcugcauuauggucggcgcuaaugccucagacagaauggggaugggaacaaccuaucuugcauugauggcuacauucaagaugaggccuauguuugccgugggccuguuauuccgccggcucacaaguagagagguucugcuucugaccauaggucuaucccucguggcaucugucgaacugccaaacagcuuggaggaacugggggauggauuagccaugggcaucaugauucucaaacugcuuacggacuuucaauccuaccagcugugggcuacauugcucucacugaccuucaucaagacuaccuuuagccuacacuaugcguggaaaacaauggccaugguacugaguauugugucucuucucccccuguguuuguccacuaccagccagaagacgacauggcugccgguuuuacucggcucgcuggggugcaagccucuuaccauguuccugaucgcagagaauaaaauauggggaaggaagucauggccauugaacgaagguaucauggcugugggcauugucucuauccuccugaguucccuacugaaaaacgaugugccccuugccgggccucucauugccggaggcaugcugaucgcuuguuacguaauaagcgguucuagcgcagacuuguccuuagagaaggccgcgguggucucaugggaggaagaggcugaacauaguggggccagccacaauauucugguugaggugcaggaugacggaacuaugaaaaucaaggaugaagaacgagacgauacacucaccauccugcuuaaagcaacucuguuggccgugucuggcgucuauccccuauccauuccagcuacacuguuugugugguacuucuggcaaaagaagaaacagcgcucaggcguucucugggacaccccuagucccccagagguagaacgggcagugcuggaugacgggauauauagaaucaugcagaggggacuuuuaggucguagccaggucggcguggggguuuuccaagagaacguguuucauacgauguggcacgucacucgcggagccgugcugauguaccagggcaagcggcucgaaccguccugggcgucugucaaaaaggacuugauuucguacggugggggauggagacugcagggcagcuggaauaccggcgaggagguccaggugaucgcuguugaaccugggaaaaaccccaagaaugugcaaacagccccaggaaccuucaagacacccgagggugaagucggcgcaauugcccucgauuuuaaaccugggacuucaggauccccaaucgugaacagggagggcaagauaguuggucuguaugggaauggaguggucaccacgaguggcacauacgugucugcuaucgcccaggcaaaagcuagccaggaaggcccccuuccugagauugaggacgaaguauuccgaaagcggaaccugacuaucauggauuugcacccgggguccggaaaaacccgcagauaucuaccagccauugugagggaggcgaucaagcggaagcugcgaacacucauauuagcccccaccagaguugucgcaucagaaauggcugaggcccugaaagguaugccuauucgcuaccaaacuaccgcugugaagucugaacauacaggcagggagaucguggaccuuaugugccacgcaacguuuacuaugcgucugcucagcccaguccggguacccaauuauaacaugaucauuauggaugaggcccauuucaccgacccuaguuccaucgccgcuagaggguacauaagcacaagggugggaaugggcgaagcggcagccauuuuuaugaccgcuacuccgcccgguucuguugaggccuucccacagucaaaugcagugauccaggaugaggaacgcgacauuccugaacgauccuggaacaguggguaugaguggaucacagauuuucccggaaaaaccgucugguucgugccaagcauaaagucgggcaaugacauugccaacuguuugaggaaaaauggcaagcggguuauccagcugucuaggaagacguuugauacugaguaccagaaaacuaagaacaacgacugggacuacguggucaccaccgauaucuccgaaaugggggcuaauuuccgcgcggaccgugugauugauccuagacggugccucaaacccguaauccugaaggacggaccagagagggugauucuugccgguccgaugccuguuacugucgcaagcgcugcccaacgccgaggcagaauagggcggaaccacaauaaagaaggagaucaguauaucuacaugggccagccccuaaacaaugacgaggaucaugcacacuggacagaggccaagaugcuguuggacaacauuaauaccccagaagguaucauccccgcuuuauucgagccugaaagggagaagucagccgcgauugauggggaauaucgccugagaggcgaggcaaggaaaacauuuguggagcucaugcggcguggagaccugccaguguggcuuaguuacaaggucgccucugaaggcuuccaauauuccgaucgccgauggugcuuugacggggagagaaacaaucagguucuggaagagaacauggauguggaaauauggacuaaagagggagagaggaagaaacuccggccccgcugguuggacgcuagaacguacagcgacccucuggcccuaagggaguucaaggaguuugcugcaggucggcgaucaguaaguggcgaucugauccucgaaauugggaaacuuccgcagcaccugacccagagagcccaaaaugcuuuagacaacuuggugaugcugcauaauagcgagcagggaggccgcgccuauaggcacgcaauggaggaacucccagauacaaucgagacucugaugcuucuggcgcucauugccgucuugaccgguggggugacacuguucuuuuuauccggccggggacuaggcaagaccucuaucgggcugcucuguguuauggcuagcuccgcccuucuguggauggcaucaguggaaccccauuggauagcugccucuaucauuuuggaguucuuucugaugguccuccugaucccugaacccgaccgucagagaacuccacaggauaaccaacuugcauacguagugauuggacuccuguucaugaucuugacgguugccgcuaaugagaugggucuguuagagaccacaaagaaagaccuaggcauagggcacguggcggucgaaaaccaccaucacgccacuaugcuggauguggaccuccauccugcaagugcuuggacccuuuacgccgucgccacaaccauuaucacucccaugaugaggcacacaauugagaacacgaccgcaaauaucucgcugacugcuauagccaaccaggcggcuaucuugaugggacuggauaagggcuggccaauuagcaaaauggacaucggugugccucuccuggcccuugggugcuauucccagguuaauccguuaacacugaccgcagccgugcucauguugguagcucauuacgcaauuaucggccccggacugcaagccaaggcgacccgcgaagcucagaaacggacagccgcaggcauaaugaagaacccaacuguggaugggauugucgccaucgaccuagauccuguuguguaugacgcuaaguuugagaaacagcugggacagaucaugcuccuuauucuguguacgucucaaaucuugcugaugcgaaccacaugggcccucugcgaaucaauaacucuggcaaccggccccuuaacaacccuuugggaggguagcccagggaaguucuggaauacuacgauugcugucuccauggccaacaucuuuagaggaaguuaccuggcgggcgccggucucgcauucucucuaaugaaaagccugggcgggggaaggcgcggcacaggggcucagggagagaccuugggcgaaaaguggaaacggcagcugaaucagcucucaaaguccgaguucaacacuuauaagagaagugguauuauggaaguggaccguagcgaggccaaagaagggcuuaggcggggagagaccacaaagcacgcaguaucucgcggcacugcuaaacugcgaugguuuguggagagaaauuugguuaagccugaagguaaagugaucgaucugggcugugggaggggaggcugguccuacuauugcgccgggcucaagaaggucaccgaggugaaaggauacacaaagggcggucccgggcacgaggaaccgauaccaauggccacguacggauggaacuuagucaaacugcauucaggcaaggacguguucuuuaucccucccgaaaaaugugauacccuucugugcgacauuggcgagagcucgccaaaucccacuaucgaggaagggcggacacuacgcguucucaagaugguagagccuuggcugagaggaaaccaauucuguauuaaaaucuugaauccguauaugcccucuguggucgaaacccuggagcagaugcagaggaagcacgguggcaugcucgugcgaaacccacuuaguagaaauuccacucaugagauguacuggguuagcugcgggacaggaaacauugugucagcggucaauaugaccucccguaugcuguuaaacagauuuacgauggcucaccgcaagccuaccuaugaaagggauguggaccugggcgcagguacacggcacguagccguggagcccgaaguugcuaacuuggauaucauagggcagagaauugagaauaucaaacaugaacacaagucuacuuggcauuacgacgaggauaacccuuauaaaaccugggccuaccacggaagcuaugaggucaagccaaguggcuccgcaagcucuauggugaauggcguggucaaacuccugacaaagcccugggacguuaucccuauggugacucaaauugccaugaccgauacaaccccauucgggcagcagcgcguauuuaaggaaaaaguggacacuaggacgcccaaggcuaaacgaggaacagcgcaaauaauggaggucaccgcccgguggcuaugggguuuccuuucaagaaacaagaaaccgaggaucuguacucgcgaagaguuuacccguaaggugcggaguaaugcagcuauuggcgccguuuucguggacgaaaaccaguggaacuccgcaaaggaggccgucgaggaugaaagauuuugggaccuggugcauagggagcgcgaacuccacaaacaggggaagugcgcuacaugcguauacaacaugaugggaaaacgagagaagaaacugggcgaguucgguaaggccaaggggagccgggcgaucugguacaugugguugggagcaagauuucuggaguucgaggcccucggcuucaugaaugaagaucacugguuuucuagggagaacucgcuuucaggcguugaaggggagggacugcauaaauuagguuauauucugcgcgacaucagcaagauaccuggcgggaauauguacgcugaugacacggccggaugggauaccagaaucacugaggacgauuugcagaacgaagcaaaaauuacagacaucauggagccagaacacgcucuccuggccaccuccauuuucaagcuaacuuaucaaaauaaagugguccgggugcagaggcccgcuaagaacggcacagugauggaugucaucagucgucgagaccagcgcgguucugggcagguuggaaccuacggccuuaauacauuuacuaacauggaggcccaacugauaagacagauggaaagcgagggcauuuucuccccuucagagcucgaaaccccaaaccuggcagagcggguguuggauugguuagaaaaauaugggguagagaggcugaagcgcauggcgaucaguggagacgacuguguggucaagcccaucgaugacagauuugccacggcucucaccgcccuuaaugauauggguaaagugcggaaggacauuccgcagugggaaccuucuaaaggcuggaacgauuggcagcaaguucccuucugcagccaucacuuucaccagcugauaaugaaggacgggagggagaucguggucccaugucgaaaucaggaugagcuagugggacgugcaagaguaucccagggcgcugguuggucacugcgcgaaacagccugccucgggaaaagcuacgcacaaauguggcaguugauguauuuccaucggagggaccugagacuugccgcgaacgcuauuuguucugccguuccuguggauuggguccccacuucccgcaccacauggaguauccacgcacaucaccaguggaugacuaccgaggacaugcugagcguguggaaucggguuuggauugaagagaacccauggauggaagauaagacgcauaucucguccuggggagacgugcccuaccucggcaagagggaggaccaauggugcggcucuuuaauagggcugacagcccgagcuaccugggccacuaauauccaggucgcaauuaaccaggugagacgguugaucggaaaugagaacuaccuggauuauaugacaucaaugaaaagguuuaagaaugaaagcgacccugagggugcucucugguga

SEQ ID NO: 13281 - RNA, 9879 nt, Artificial Sequence
  derived and/or modified CDS sequence (opt3) from DENV-1__FJ639674__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccaugagcuuaucuaugacuuguauugcuguuggccuggucacacuauaccucggggugauggugcaggccgauucaggaugcgucaucaacuggaaaggccgcgaacugaagugugguagugggaucuuuguuaccaaugaggugcacacauggacugaacaauauaaguuccaggcagacagcccgaaaagacuuuccgccgcuauuggaaaggccugggaggagggcgugugcgguauaaggucugcaacccgguuggaaaacaucauguggaaacagauuucgaacgagcugaaucauauccuccuggaaaacgacaugaaguuuacgguagucgugggcgauguugcugggauuuuagcccagggcaagaagaugauccgcccucaacccauggaguacaaauauagcuggaaguccuggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauucauauacucaggugugcgaccaccguuugaugagugcagccauuaaagauucuaaggcuguucacgccgacaugggguacuggaucgaaagcgagaaaaaugaaaccuggaagcucgcacgggcguccuucauugaggugaagacauguaucuggccaaaaucacauacgcuguggagcaacggaguacuagaaucugagaugauaauccccaagauuuauggcgguccuaucucccaacacaauuaccgaccaggcuacuuuacccagacugccgggccguggcaucugggaaaacucgagcuggauuucgaccuuugcgaaggcacaaccgucgugguggaugagcacugcgggaacagaggacccaguuugaggacuacaaccgucacgggcaagauuauccacgaaugguguugccgcagcuguacucugccuccauuacgguuuaaaggugaggacgggugcugguauggaauggagauaagacccguuaaggaaaaggaggaaaaucucgugaaaucuaugguauccgcuggcucaggugagguggacaguuucagccugggccuucuguguauuucgaucaugaucgaagaggucaugaggucccgcuggucucgaaagauguugaugaccgggacacucgccguguuuuuccugcuaauuaugggacagcugaccuggaacgaucucauccggcugugcauuaugguuggcgcaaaugcuagcgaccguauggggaugggaacuacauaccuugccuugauggcaaccuuuaaaaugagaccuauguucgccgugggccuguuauuuaggcgccucacaucacgggagguccugcuucugacuauaggucuaagucucguggcuuccguugaacugccaaacucuuuggaggaacugggggauggauuagcgaugggcaucaugauucucaagcugcuuaccgacuuccaaagccaucagcugugggccacguugcucucccugacauuuaucaaaaccacuuucucacuacacuaugcauggaagaccauggcuauggugcugagcauugucagucuuuuuccccucugucugucuacaacuucccagaagaccacgugguugccgguacuguuaggcagccucgggugcaaaccucugacaauguuccuuaucgccgagaauaagauauggggaagaaaaucguggccacugaacgaagguaucauggccgugggcauuguuucaaucuugcucucuagucugcuaaagaacgaugugccccuggcugggccucuuauugcaggaggcaugcucaucgccuguuacgucauauccgguagcucugcggaccugagcuuggagaaagcugccgagguguccugggaagaggaagcagagcauucaggggccagucacaauauuuuaguagaagugcaggaugacggaaccaugaagaucaaagaugaggagagggacgauacucugacaauccuccugaaggcuacccuucuggcagucagcggcguuuaucccuugucuauuccagccacucuauucgugugguacuuuuggcaaaagaaaaagcagcgauccggcgugcugugggacacaccuucacccccagaagucgagcgcgcggugcucgaugacgggauauaucggaucaugcagagaggacugcuugguaggagucagguuggcguagggguguuccaagaaaacgucuuucauaccauguggcacgugacgcguggagcuguuuuaauguaccagggcaaacgccuggagccgagcugggccuccgugaagaaagaccucauuucuuacggugggggauggcgguugcagggcucguggaauacuggcgaggaaguccaggugaucgcaguagagccugggaagaaccccaagaauguccaaaccgccccaggaacauucaaaaccagcgaaggugaggugggcgcuauugcccuggauuuuaagcccgggacaucaggauccccuaucguuaacagagaaggcaaaauagugggucucuaugggaauggagucgugacuaccaguggcacguacguuucugcaaucgcucaggccaaggcgagccaggagggcccacugcccgagauugaagacgagguguucaggaaacgaaaccuuacaaucauggaucugcacccuggguccggaaagacucggcgcuauuugccggccauugucagagaagcaaucaagaggaaacuacggacccugauacucgcuccaacacgagugguagccucagagauggcugaagcauuaaaggguaugcccauuagauaccaaaccacugccgugaaaucugagcauaccggcaaggagaucguugaccugaugugccacgccacauuuacgaugcgccuucugagcccugucagggugccaaauuauaacaugaucauuauggaugaagcucauuucacugaccccaguuccaucgcggcacguggguacauaagcacccgggugggaaugggcgaggccgcugccauuuuuaugacagcaaccccuccggguucugucgaagccuucccccagucaaaugcuguaauccaggaugaggaaagagacauuccagagagguccuggaacaguggguaugaguggaucacugauuuuccuggaaaaacagugugguucguucccagcauaaagucgggcaaugacauugcgaacugucuccgcaagaauggcaaacgagugauccaguugucuagaaagaccuucgauacggaauaccagaagacuaagaacaacgacugggacuacgucgugacaaccgauaucuccgagaugggggccaauuuucgggcagacaggguuauugauccacgccguugccugaaaccugugauccucaaggacggacccgaaagagucauucuggcugguccaaugccggugaccguagccagcgcagcccagcggaggggccgcauagggcgaaaccacaauaaggagggagaucaguauaucuacaugggccagccucuuaacaaugacgaggaucaugcucacuggacugaagccaaaaugcuacuggacaacauuaauacacccgaggguaucaucccagcguuguucgaacccgagagagaaaagucagcagccauugauggggaguaucgguuaaggggcgaggcucgcaaaaccuuuguggaacugaugagaaggggagaccucccuguuuggcugaguuacaaggucgccucugagggcuuccaauauuccgaucggcguuggugcuuugacggggaacgcaacaaucaggugcuugaggaaaacauggauguggagauauggacaaaagagggagaacgaaagaaacugagaccaagguggcucgacgcucggacuuacagcgaccccuuggcacugcgcgaguucaaggaauuugccgcugguagaaggucagucaguggcgaucuaauccuggagauugggaagcucccucagcaccuuacgcagcgggcccaaaaugcacuggacaacuuaguuauguugcauaauagcgaacagggaggccgagcguauagacacgccauggaggagcugccggauaccaucgaaacacucaugcugcuugcucugauugccgugcucacuggugggguaaccuuguucuuucuguccggccgcggauuaggcaaaacaucuaucgggcuacugugugugauggcaagcuccguccuccuuuggauggcuucaguggagccacauuggauagccgcaucuaucauucuggaguucuuuuugaugguucugcucauccccgagccugacaggcagcggacaccccaggauaaccaacuggccuacguggucauuggacuucucuucaugauccugacuguagcugcgaaugagauggguuugcuggaaacgaccaagaaagacuuaggcauagggcacguggccguugagaaccaccaucacgcagcuaugcuagauguggaccugcauccagccagugccuggacacucuacgcagucgcuacuaccauuaucacaccuaugaugcgucacaccauugaaaacacuacagccaauaucucgcuuacggcgauagcuaaccaggccgcaauccugaugggauuggauaagggcuggcccauuagcaaaauggacaucggugugccacugcucgcccuggggugcuauucccaggucaauccucuuaccuuaacugcugcagugcugaugcucguugcccauuacgcgauuaucggcccgggauugcaagcuaaggccacaagagaggcacagaagaggaccgccgcuggcauaaugaaaaaccccaccguggaugggauuguagccaucgaccuggauccaguggucuaugacgcaaaguuugaaaaacagcuaggacagaucaugcugcucauucuuuguacaucucaaauccuguugaugcgcacuacgugggcucugugcgagucaauaacccucgccacaggcccucugacuaccuuaugggaggguagccccgggaaguucuggaauacaaccauugcgguuuccauggccaacaucuuccggggaaguuaccuugcaggcgcuggucuggccuuuucucucaugaaaagccuaggcgggggacgaagaggcacuggggcacagggagaaacgcugggcgagaaguggaagaggcaguugaaucagcugucaaaauccgaguucaacacauauaagcgcagugguauuauggagguggaccggagcgaagcuaaagaggggcucaagagaggagagaccacuaaacacgccgucucucguggcaccgccaaacuuaggugguuuguggaacggaaucugguaaagccagaggguaaagugaucgauuugggcugugggcgcggaggcugguccuacuauugcgcggggcugaagaaaguuacagaagugaagggauacacuaaaggcgguccugggcacgaggaacccauaccgauggcuaccuacggauggaaccucgucaaguuacauucaggcaaagacguguucuuuaucccaccugagaagugugauacacugcuuugcgacauuggcgagagcucgcccaauccaacgaucgaagaggggcgaacccugagaguccuaaagaugguggaacccuggcucaggggaaaccaauucuguauuaaaauccugaauccuuauaugccgucuguuguagagacuuuggagcagaugcagcggaagcacgguggcaugcuggugcgcaacccccucaguagaaauuccacacaugaaauguacugggucagcugcgggaccggaaacauugugucagcaguuaauaugacuuccaggaugcuucugaaccgauuuacaauggcccaccggaaaccaaccuaugagcgugauguggacuuaggcgcugguacgagacacgucgccguggaaccugagguagcaaaccuggauaucauagggcagcgcauugaaaauaucaagcaugagcacaaaucuaccuggcauuacgacgaggauaaccccuauaagacaugggccuaccacggaagcuaugaagugaagccuaguggcuccgcuagcucuaugguuaauggcgucgugaaauugcucacuaagccaugggacgugauccccauggucacccaaauugcgaugacagauacuaccccuuucgggcagcagaggguuuuuaaagagaagguggacacacggaccccaaaagccaagagaggaacugcacaaauaauggaaguaacggcuaaguggcugugggguuuccuaucacgcaacaaaaagcccaggaucuguacacgagaggaauuuacccggaaagugagaaguaaugccgcaauuggcgccgucuucguggacgagaaccaguggaacuccgcuaaggaggccguugaagaugagagguuuugggaccuugugcaucgcgaacgugagcugcacaaacaggggaagugcgcgacuugcgucuacaacaugaugggaaagcgggagaaaaagcucggcgaguucgguaaagcaaaggggagcagagccaucugguacauguggcugggagcuagguucuuggaguuugaagcccugggcuucaugaaugaggaucacugguuuucucgcgaaaacucgcucucaggcguggagggggagggacuucauaaacuggguuauauuuuacgagacaucagcaagauaccgggcgggaauauguacgcagaugacaccgcuggaugggauacacggaucacggaagacgaucugcagaacgaggccaaaauuaccgacaucauggaaccugagcacgcuuugcucgccaaguccauuuucaagcugacuuaucaaaauaaaguaguuagagugcagaggccagucaagaacggcacagugauggaugugaucagucgcagagaccagcgggguucugggcaggucggaaccuacggccuaaauacuuuuacaaacauggaagcacaacuuauaaggcagauggagagcgagggcauuuucucccccucagaacuggagaccccuaaccucgcggggcguguucuggauugguuggaaaaacauggaguggagcgauuaaagcgcauggccaucaguggugacgacuguguagugaaaccaaucgaugacagauuugcuacagcccugacugcacucaaugauaugggcaagguccggaaggacauuccccagugggaaccgucuaaaggguggaacgauuggcagcaagugccuuucugcagccaccacuuucaucagcuuauaaugaaggacggaagggagaucguugugcccugucgcaaucaggaugagcuggucggcagagcucgggugucccagggugccggguggucacuaagggaaaccgcaugccugggaaaaagcuaugcccaaauguggcagcucauguacuuccaccgacgugacuugagacuggcggcuaacgccauuuguucugcaguaccaguugauugggugccuacgucccgcaccacauggaguauccaugcccaccaucaguggaugacuaccgaggacaugcuuagcgucuggaaucggguguggauugaagagaaccccuggauggaagauaagacacacaucucguccuggggcgacguuccauaucugggcaaaagggaggaccaauggugcgggucucucauaggauuaacugcuagagccaccugggcaacgaauauccagguggcuauuaaccagguccgccggcugaucgguaaugagaacuacuuggauuacaugacaucaaugaagagguuuaagaaugaaagcgaccccgagggcgcccugugguga

SEQ ID NO: 13282 - RNA, 9879 nt, Artificial Sequence
  derived and/or modified CDS sequence (opt3) from DENV-1__FJ639675__SS-prME
agcgugaccaugcugcucaugcuuaugcccaccgcacuggcuuuccacuugacuacgagaggaggggaaccucauaugaucgucuccaagcaggaaagggggaaaucuuuacuguuuaagaccucagccgguguuaauaugugcacacuaauugccauggaccucggagaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggacucuucaaacuggagaaggaagucgcugagacucagcacgguaccgugcuuguucagauaaaguacgagggcacggacgcgccuugcaaaaucccauuuucgacacaagaugaaaagggggugacccagaacggacgcuugauuacugcaaaucccaucguaacagacaaagagaagccugucaacauagaagccgagccacccuucggcgagucuuauauugugaucggugcuggggaaaaagcccugaagcucuccugguuuaagaaaggcucaaguaucggaaagauguucgaggcaaccgccagaggcgcuaggcggauggccauucugggggauacugcaugggacuuuggaagcaucgguggcguuuucaccuccguggggaaacuuguccaucagauuuuuggaacagcguacggcgugcuguucucugguguaagcuggacgaugaagauagggaucggcguguugcucaccuggcugggauuaaauucacgaaguacuucccugagcaugacauguauugcuguuggccuagucacccucuaccugggggugauggugcaggccgauucuggaugcgucaucaacuggaaaggccgcgaacuuaagugugguucagggaucuuuguuacaaaugaggugcacacuuggaccgaacaauauaaguuccaggcagacaguccgaaaagauugagcuccgccauuggaaaggcuugggaggagggcgugugcgguauaaggucugccacgcggcuggaaaacaucauguggaaacagauuucgaacgagcucaaucauauccuguuagaaaacgacaugaaguuuacaguagucgugggcgauguugcagggauucuggcucagggcaagaagaugauccgcccucaacccauggaguacaaauauagcuggaaguccuggggcaaggccaaaauaaucggggcggacgugcagaauaccacuuucauuaucgauggaccaaacaccccugaaugucccgacgaucagagagccuggaauauuugggaggucgaggacuacggcuuugguaucuucacaacuaacauauggcuuaaguugagggauucauauacccaggugugcgaccaccgucucaugagugcugcaauuaaagauucuaaggccguucacgcugacaugggguacuggaucgaaagcgagaaaaaugaaacauggaagcuggcccgggcauccuucauugaggugaagacguguaucuggccaaaaucacauacccuauggagcaacggaguacuggaaucugagaugauaauccccaagauuuauggcgguccuaucucccaacacaauuaccgaccaggcuacuuuacucagacagcggggccguggcaucucggaaaacuggagcuugauuucgacuugugcgaaggcaccacugucgugguggaugagcacugcgggaacagaggacccagucugaggacaaccacggucacuggcaagauuauccacgaaugguguugccgcagcuguaccuuaccuccacuccgguuuaaaggugaggacgggugcugguauggaauggagauaagacccguuaaggaaaaggaggaaaaucuggugaaaucuaugguauccgccggcucaggugagguggacaguuucagccuuggccuguuguguauuucgaucaugaucgaagaggucaugaggucccgcuggucucgaaagaugcucaugacagggacccuggcuguguuuuuccuacugauuaugggacagcucacuuggaacgaucugauccggcuuugcauuaugguuggcgccaaugcaagcgaccguauggggaugggaaugacauacuuggcucugauggccaccuuuaaaaugagaccuauguucgcagugggcuuacucuuuaggcgccugacaucacgggagguccuucugcuaacuauaggucucagucugguggccuccguugaauugccaaacucucuggaggaauuaggggauggacucgcuaugggcaucaugauucugaaacuucugaccgacuuccaaagccaucaguugugggcgacgcuccugucccuaacauuuaucaaaaccacuuucucacugcacuaugccuggaagaccauggcaauggugcuuagcauugucagucucuuuccccuguguuugucuacaacuucccagaagaccacguggcugccgguauuacucggcagccuggggugcaaaccucuuacaauguuccugaucgcugagaauaagauauggggaagaaaaucguggccauugaacgaagguaucauggccgugggcauuguuucaauccuccugucuagucuacugaagaacgaugugccccuugccgggccucucauugcuggaggcaugcugaucgcauguuacgucauauccgguagcucugccgacuugagcuuagagaaagcggcugagguguccugggaagaggaagccgagcauucaggggcaagucacaauauucugguagaagugcaggaugacggaaccaugaagaucaaagaugaggagagggacgauacucucacaauccugcuuaaggccacccuguuggcugucagcggcguuuauccccuaucuauuccagcaacucuguucgugugguacuuuuggcaaaagaaaaagcagcgauccggcgugcucugggacacaccuucacccccagaagucgagcgcgccgugcuggaugacgggauauaucggaucaugcagagaggacuuuuagguaggagucagguuggcguagggguguuccaagaaaacgucuuucauaccauguggcacgugacgcguggagcgguucugauguaccagggcaaacgccucgagccgagcugggcuuccgugaagaaagacuugauuucuuacggugggggauggcggcugcagggcucguggaauacuggcgaggaaguccaggugaucgccguagagccugggaagaaccccaagaauguccaaaccgcaccaggaacauucaaaaccagcgaaggugaggugggcgccauugcucucgauuuuaagcccgggacaucaggauccccuaucguuaacagagaaggcaaaauagugggucuguaugggaauggagucgugacuaccaguggcacguacguuucugccaucgcacaggcuaaggccagccaggagggcccacuucccgagauugaagacgagguguucaggaaacgaaaccugacaaucauggauuugcacccuggguccggaaagacucggcgcuaucuaccggcgauugucagagaagccaucaagaggaaacugcggacccucauauuagcaccaacacgagugguagcuucagagauggccgaagcucugaaggguaugcccauuagauaccaaaccacugcagugaaaucugagcauaccggcaaggagaucguugaccuuaugugccacgccacauuuacgaugcgccugcucagcccugucagggugccaaauuauaacaugaucauuauggaugaagcccauuucacugaccccaguuccaucgcugcgcguggguacauaagcacccgggugggaaugggcgaggcagccgcuauuuuuaugacagccaccccuccggguucugucgaagcauucccccagucaaaugccguaauccaggaugaggaaagagacauuccagagagguccuggaacaguggguaugaguggaucacugauuuuccuggaaaaacagugugguucguucccagcauaaagucgggcaaugacauugcuaacuguuugcgcaagaauggcaaacgagugauccagcugucuagaaagaccuucgauacggaauaccagaagacuaagaacaacgacugggacuacgucgugacaaccgauaucuccgagaugggggcgaauuuucgggccgacaggguuauugauccacgccguugccucaaaccugugauccugaaggacggacccgaaagagucauucuugcagguccaaugccggugaccguagcuagcgccgcacagcggaggggccgcauagggcgaaaccacaauaaggagggagaucaguauaucuacaugggccagccucuaaacaaugacgaggaucaugcccacuggacugaagcuaaaaugcuguuggacaacauuaauacacccgaggguaucaucccagccuuauucgaacccgagagagaaaagucagcggcaauugauggggaguaucggcugaggggcgaggcccgcaaaaccuuuguggaacucaugagaaggggagaccugccuguuuggcuuaguuacaaggucgcuucugagggcuuccaauauuccgaucggcguuggugcuuugacggggaacgcaacaaucaggugcuggaggaaaacauggauguggagauauggacaaaagagggagaacgaaagaaacucagaccaaggugguuggacgcccggacuuacagcgacccccuggcucuacgcgaguucaaggaauuugcagccgguagaaggucagucaguggcgaucugauccucgagauugggaaacuuccucagcaccugacgcagcgggcucaaaaugccuuagacaacuugguuaugcugcauaauagcgaacagggaggccgagcauauagacacgcgauggaggagcucccggauaccaucgaaacacugaugcuucuggcccucauugcuguguugacuggugggguaacccuguucuuuuuauccggccgcggacuaggcaaaacaucuaucgggcugcucugugugauggccagcuccguccuucuguggauggcaucaguggagccacauuggauagcugccucuaucauuuuggaguucuuucugaugguucuccugauccccgagccugacaggcagcggacaccccaggauaaccaacuugcauacguggucauuggacuccuguucaugaucuugacuguagccgcuaaugagaugggucuguuagaaacgaccaagaaagaccuaggcauagggcacguggcgguugagaaccaccaucacgccgcaaugcuggauguggaccuccauccagcuagugccuggacacuuuacgccgucgcaacuaccauuaucacaccuaugaugcgucacaccauugaaaacacuacagcuaauaucucgcugacggccauagcgaaccaggcugccaucuugaugggacuggauaagggcuggcccauuagcaaaauggacaucggugugccacuccuggcacuugggugcuauucccaggucaauccuuuaacccugacugccgcugugcucauguugguugcacauuacgccauuaucggcccgggacugcaagcgaaggcuacaagagaggcccagaagaggaccgcagccggcauaaugaaaaaccccaccguggaugggauuguagcuaucgaccuagauccaguggucuaugacgccaaguuugaaaaacagcugggacagaucaugcuccuuauucuguguacaucucaaaucuugcugaugcgcacuacgugggcacucugcgagucaauaacccuggcuacaggcccuuuaacuacccuuugggaggguagccccgggaaguucuggaauacaaccauugccguuuccauggcgaacaucuuccggggaaguuaccuggccggcgcaggucucgcuuuuucucuaaugaaaagccugggcgggggacgaagaggcacuggggcccagggagaaacguugggcgagaaguggaagaggcagcugaaucagcucucaaaauccgaguucaacacauauaagcgcagugguauuauggagguggaccggagcgaagcaaaagaggggcuuaagagaggagagaccacuaaacacgcugucucucguggcaccgccaagcugaggugguuuguggaacggaauuugguaaagccagaggguaaagugaucgaucugggcugugggcgcggaggcugguccuacuauugcgccgggcucaagaaaguuacagaagugaagggauacacuaaaggcgguccugggcacgaggaacccauaccgauggcgaccuacggauggaacuuagucaagcugcauucaggcaaagacguguucuuuaucccaccugagaagugugauacacuucugugcgacauuggcgagagcucgcccaauccaacgaucgaagaggggcgaacccuaagaguccucaagaugguggaacccuggcugaggggaaaccaauucuguauuaaaaucuugaauccuuauaugccgucuguuguagagacucuggagcagaugcagcggaagcacgguggcaugcucgugcgcaacccccuuaguagaaauuccacacaugaaauguacugggucagcugcgggaccggaaacauugugucagcuguuaauaugacuuccaggaugcuguuaaaccgauuuacaauggcacaccggaaaccaaccuaugagcgugauguggaccugggcgccgguacgagacacgucgcuguggaaccugagguagccaacuuggauaucauagggcagcgcauugaaaauaucaagcaugagcacaaaucuaccuggcauuacgacgaggauaaccccuauaagacaugggcauaccacggaagcuaugaagugaagccuaguggcuccgccagcucuaugguuaauggcgucgugaaacuccugacuaagccaugggacgugauccccauggucacccaaauugcuaugacagauacuaccccuuucgggcagcagaggguuuuuaaagagaagguggacacacggaccccaaaagcgaagagaggaacugcccaaauaauggaaguaacggcaaaguggcuaugggguuuccuuucacgcaacaaaaagcccaggaucuguacacgagaggaauuuacccggaaagugagaaguaaugcugccauuggcgcagucuucguggacgagaaccaguggaacuccgccaaggaggcuguugaagaugagagguuuugggaccuggugcaucgcgaacgugagcuccacaaacaggggaagugcgccacuugcgucuacaacaugaugggaaagcgggagaaaaagcugggcgaguucgguaaagcgaaggggagcagagcaaucugguacaugugguugggagccagguuccuggaguuugaagcucucggcuucaugaaugaggaucacugguuuucucgcgaaaacucgcuuucaggcguggagggggagggacugcauaaauuagguuauauucugcgagacaucagcaagauaccgggcgggaauauguacgccgaugacaccgcaggaugggauacacggaucacggaagacgauuugcagaacgaggcuaaaauuaccgacaucauggaaccugagcacgcccuccuggcuaaguccauuuucaagcuaacuuaucaaaauaaaguaguuagagugcagaggccagccaagaacggcacagucauggaugugaucagucgcagagaccagcgggguucuggacaggugggaaccuacggccuuaauacuuuuacaaacauggaagcacaacugauaaggcagauggagagcgagggcauuuucucccccucagaacucgagaccccuaaccuggcggaacgugucuuggauugguuagagaaacaugggguugaacgacugaagcgcauggccaucaguggagacgacugugugguaaaaccaaucgaugacagauuugcuacagcccucacugcacuuaaugauauggguaaggugcggaaggacauuccccagugggagccgucuaaaggcuggaacgauuggcagcaagucccuuucugcagccaccacuuucaucagcugauaaugaaggacgggagggagaucgugguucccugucgcaaucaggaugagcuagugggcagagcucgggucucccagggcgccgguuggucacugagggagaccgcaugccucgggaaaagcuaugcccaaauguggcaguugauguacuuccaccgacgugaccugagacuugcggcuaacgccauuuguucugcagugccaguagauuggguuccuacgucccgcaccacauggaguauccaugcccaccaucaguggaugacuaccgaagacaugcugagcguguggaaucgggucuggauugaggaaaaccccuggauggaggauaagacacacaucucguccuggggagacgugccauaucucggcaaaagggaggaccaauggugcggcucuuuaauagggcugacugcuagagccaccugggcaacgaauauccagguugcuauuaaccaggugcgccgguugaucggaaaugaaaacuaccuggauuacaugacaucaaugaagagguuuaagaaugagagcgaccccgaaggugcccucugguga

SEQ ID NO: 13283 - RNA, 9879 nt, Artificial Sequence
  derived and/or modified CDS sequence (opt3) from DENV-1__FJ639676__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugccggccuggguuuggagaccagagcagaaacauggauguccucugagggggccuggaaacagauccagaggguggaaacuugggcucuccggcacccuggauucaccguuauugcacuguuucuggcccaugugaucggcacaucgauuacccagaagggcaucauauucauccucuuaaugcuggucacgccaucaauggcuaugcgcugcguggggauuggaagcagagauuuuguagagggucuuaguggcgccacuuggguugacguggucuuggagcacggguccugugugacaaccauggcgaaggauaaacccacucuggacaucgaacuacucaagacagaggugaccaacccugcaguccugaggaaacuuugcauugaagccaagaucucuaauacgaccacagauagccgguguccaacucaaggagaggcuacccugguugaagagcaggacgccaacuucgugugccgccgaacauuuguagauagaggcugggguaauggguguggauuguucggcaaaggcucccucauaacuugcgcaaaguuuaagugcgugaccaaacuggaggggaagauuguccaguacgaaaacuuaaaauauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaaggacuggacuggacuucaacgaaaugguguugcuaacaaugaaggagaaauccuggcugguacauaagcagugguuucucgaucugccgcuucccuggacgucaggcgccagcaccagucaagagacuuggaaucggcaggaccuguugguuacauucaaaaccgcacacgcuaagaagcaggaaguggucgugcucgguucucaagagggggccaugcacacagcucugacuggcgccaccgaaauccagacguccggaaccacaacuauuuuugcaggccauuuaaaaugccgucugaagauggauaaacuaacccucaaggggaugagcuaugucauguguacaggaucguucaaacuggagaaggaaguggccgagacucagcacgguaccguucuugugcagauaaaguacgagggcacggacgcuccuugcaaaaucccauucucuacacaagaugaaaaggggguaacccagaacggacgcuugauuacugcgaaucccaucgucacagacaaagagaagccugugaacauagaagcagagccacccuuuggcgaguccuauauuguuaucggugccggggaaaaagcucugaagcucucaugguucaagaaaggcaguagcaucggaaagauguuugaggccaccgcaagaggcgccaggcggauggcuauucugggggauacugccugggacuucggauccaucgguggcguguuuaccucugucgggaaacuugugcaucagauuuucggaacagcauacggcguacuguuuagcggugugucauggacgaugaagauagggaucggcguuuugcucaccuggcugggauuaaauagucgauccacuagccugucuaugacauguauugcggucggccuagugacccucuaccugggggugaugguccaggcugauucaggaugcguuaucaacuggaaaggccgcgaacuuaagugugguagugggaucuucgugacaaaugaggugcacacuuggaccgaacaauauaaguuucaggccgacagcccgaaaagauuguccgcagccauuggaaaggcuugggaggagggcguaugcgguauaaggucugccacgcggcuggaaaacaucauguggcgccagauuucgaacgagcucaaucauauccuguuagaaaacgacaugaaauucacagucgugguuggcgauguggucgggauucuggcacagggaaagaaaaugaucagaccucaacccauggagcacaaguacagcuggaaauccuggggcaaggcuaagauaaucggggccgacgugcagaauaccacuuuuauuaucgauggaccaaacaccccugaaugucccgacgaucagagggcguggaauauuugggagguugaggacuauggcuucgguaucuuuacaacuaacauauggcuuaaauugcgugauucauacacccaggugugcgaccaccggcucaugagugccgcuauuaaggauucuaaagcaguacaugccgacaugggguauuggaucgaaagcgagaagaaugaaacauggaaacuggcucgagccuccuucauugaggucaagacguguaucuggccaaagucacacacccuauggagcaacggagugcuggaaucugagaugauaauccccaaaauuuacggcgguccuaucucccaacauaauuauagaccaggcuacuucacucagacagcagggccguggcaccucggaaagcuggagcuugauuuugacuugugcgaaggcaccacuguggucguugaugagcacugcgggaacaggggacccagucugcgcacaaccacggugacuggcaaaauuauccaugaaugguguugccggagcuguaccuuaccuccacucagauucaagggugaggacgggugcugguacggaauggagauaaggcccguaaaagaaaaggaggaaaaucuggugaagucuauggucuccgcgggcucaggugagguggacaguuuuagccuuggccuguuguguauuucgaucaugaucgaagagguuaugcgcucccgauggucucggaaaaugcucaugacagggacccuggccguguucuuucuacugauugucggacagcucacuuggaacgaucugauccgucuuugcauuauggugggcgcuaaugccagcgacagaauggggaugggaacaaccuauuuggcacugauggcuacauucaagaugaggccuauguuugccguuggcuuacucuuccgccggcugacuucaagagaggugcuucugcuaaccauaggucucagucuggucgcauccguagaauugccaaacucucuggaggaauuaggggauggacucgccaugggcaucaugauucugaaacuucugacggacuuucaaagcuaccaguugugggcuacacuccugucccuaaccuucaucaagacuaccuuuucacugcacuaugcguggaaaacaauggccauggugcuuagcauuguuagucuccugcccuugugucugucuacuaccucccagaagacgacaugguuaccggugcuccugggcagccuugggugcaagccucugaccauguucuuuaucgcagagaauaaaauauggggaaggaagucguggccauugaacgaagguaucauggcugucggcauugugucaauccuccugucuagucuacugaaaaacgauguaccccuugccgggccucucauugccggaggcaugcugaucgcuuguuacgugauauccgguagcucugcagacuugagcuuagagaaggccgcggaggucuccugggaagaggaagcugagcauucaggggccagucacaauauucugguugaagugcaggaugacggaacuaugaaaaucaaggaugaggagcgagacgauacacucaccauccugcuuaaagcaacucuguuggccgugagcggcgucuauccccuaucuauuccagcuacacuguucgugugguacuucuggcaaaagaagaaacagcgcuccggcguucucugggacaccccuucacccccagaaguagagcgggcagugcuggaugacgggauauauagaaucaugcagaggggacuuuuaggucguagucaggucggcguggggguuuuucaagaaaacguguuccauacgauguggcacgucacucgcggagccgugcugauguaccagggcaagcggcucgagccgagcugggcguccguaaaaaaggacuugauuucuuacggugggggauggagacugcagggcucguggaauaccggcgaggaaguccaggugaucgcuguugagccugggaaaaaccccaagaaugugcaaacagccccaggaaccuuuaagacacccgaaggugaggucggcgcaauugcccucgauuucaaaccugggacuagcggaucaccaaucgugaacagggaaggcaagauaguuggucuguaugggaauggaguggucaccacguccggcacauacgugagugcuaucgcccaggcaaaagcuucucaggagggcccccuuccugagauugaagacgagguauuucgaaagcggaaccugacuaucauggauuugcacccggggagcggaaaaacccgcagauaucuaccagccauugugagggaagcgaucaagcggaagcugcgaacacucauauuagcccccaccagaguugucgcauccgagauggcugaagcccugaaagguaugccuauucgcuaccaaacuaccgcugugaagucagagcauacaggcagggagaucguggaccuuaugugccacgcaacguucacuaugcgucugcucucuccaguccggguacccaauuauaacaugaucauuauggaugaagcccauuuuaccgacccuagcaguaucgccgcuagaggguacauauccacaagggugggaaugggcgaggcggcagccauuuucaugaccgcuacuccgcccgguagcguugaagccuuuccacagucuaaugcagugauccaggaugaggaacgcgacauuccugagcgaucauggaacuccggguaugaguggaucacagauuuccccggaaaaaccgucugguuugugccaaguauaaagagcggcaaugacauugccaacuguuugagaaaaaauggcaagcggguuauccagcugucgaggaagacguucgauacugaauaccaaaaaacaaagaacaacgacugggacuacguggucaccaccgauaucucugagaugggggcuaauuuccgcgcggaccgugugauugauccuagacggugccucaaacccguaauccugaaggacggaccagaaagggugauucuugccgguccgaugccuguuacugucgcauccgcugcccagcgccgaggcagaauagggcggaaccacaauaaagagggagaucaguauaucuacaugggccagccccuaaacaaugacgaggaucaugcacacuggacagaagccaagaugcuguuggacaacauuaauaccccagaggguaucauccccgcuuuauuugaaccugagagggaaaagagcgccgcgauugauggggaguaucgccugagaggcgaggcaaggaaaacauucguggaacucaugcggcguggagaccugccaguguggcuuucauacaaggucgccagugagggcuuucaauauucugaucgccgauggugcuucgacggggaaagaaacaaucagguucuggaggaaaacauggauguggagauauggacuaaagagggagaaaggaagaaacuccggccccgcugguuggacgcuagaacguacuccgacccucuggcccuaagggaguuuaaggaauucgcugcaggucggcgaagcaucucaggcgaucugauucucgagaucgggaaacuuccgcagcaccugacccagagagcccaaaaugcuuuagacaacuugguaaugcugcauaauagugaacagggaggccgcgccuauaggcacgcaauggaggagcucccagauacaauugaaacucugaugcuucuggcgcucaucgccguguugaccgguggggucacacuguuuuucuuaagcggccggggacuaggcaagaccuccauagggcugcucugugugauggcuucuagcgcccuucuguggauggcauccguugagccccauuggaucgcugccucaauuaucuuggaauuuuuccugauggugcuccugauuccugagcccgaccgucagagaacuccacaggauaaccaacuugcauacgucguaaucggacuccuguuuaugauauugacgguggccgcuaaugagaugggucuguuagaaaccacaaagaaagaccuaggcauugggcacguugcgguggagaaccaccaucacgccacuaugcuggaugucgaccuccauccugcaucugcuuggacccuuuacgccguggccacaaccaucauuacucccaugaugaggcacacaaucgaaaacacgaccgcaaauauaagucugacugcuaucgccaaccaggcggcuauuuugaugggacuggauaagggcuggccaaucucgaaaauggacauuggugucccucuccuggcccuugggugcuauagccaggugaauccguuaacacugaccgcagccguucucauguugguggcucauuacgcaaucauaggccccggacugcaagccaaggcgacccgcgaggcucagaaacggacagccgcaggcauuaugaagaacccaacuguagaugggaucguggccaucgaccuagauccugucguuuaugacgcuaaguucgaaaaacagcugggacagauuaugcuccuuauccuguguacgucccaaauauugcugaugcgaaccacaugggcccucugcgagucuauuacucuggcaaccggccccuuaacaacccuuugggaggguucaccagggaaguuuuggaauacuacgaucgcugugagcauggccaacauuuucagaggauccuaccuggcgggcgccggucucgcauucagucuaaugaaaucucugggcgggggaaggcgcggcacaggggcucagggagaaaccuugggcgagaaguggaaacggcagcugaaucagcucagcaagucagaauuuaacacuuauaagagauccgguauccuugaggucgaccguagugaagccaaagaggggcugaggcggggagagaccacaaagcacgcagugagccgcggcacugcuaaauugcgaugguucguagaaagaaaucuggugaagccugaggguaaaguuauagaucucggcugugggaggggaggcuggucuuacuauugcgccggguuaaagaaggugaccgaagucaaaggauacacaaagggcggucccgggcacgaggaaccgaucccaauggccacguacggauggaaccuggugaaacuucauuccggcaaggacgucuuuuucauuccucccgagaaaugugauacccugcuaugcgacaucggcgagucaagcccaaaucccacuauugaagaggggcggacacuccgcgugcugaagaugguugaaccuugguugagaggaaaccaauuuuguaucaaaauucugaauccguauaugcccucgguaguggagacccucgagcagaugcagaggaagcacgguggcaugcuuguccgaaacccacugucucggaauaguacucaugaaauguacuggguguccugcgggacaggaaacaucguuagcgcggugaauaugaccucacguauguuacugaacagauucacgauggcucaccgcaagccuaccuaugagagggaugucgacuugggcgcagguacacggcacguggccguagaacccgagguggcuaaccucgauauaauugggcagagaaucgaaaauaucaaacaugagcacaaguccacuuggcauuacgacgaggauaacccuuauaaaaccugggccuaccacggaucuuaugaaguuaagccaagcggcagugcauccagcauggucaauggcguggugaaacugcuaacaaagcccugggacgucauuccuaugguuacucaaauagccaugaccgauacaaccccauuugggcagcagcgcguguucaaggagaaaguagacacuaggacgcccaaggcuaaacgaggaacagcgcaaaucauggaagugaccgcccgguggcuuugggguuuucugucuagaaacaagaaaccgaggauuuguacucgcgaggaauucacccguaagguccggucaaaugcagcuaucggcgccguguuuguugacgagaaccaguggaauagugcaaaggaggccguggaagaugagagauucugggaccucguccauagggaacgcgagcugcacaaacaggggaagugcgcuacaugcguguacaacaugaugggaaaacgagaaaagaaauugggcgaguuugguaaggccaaggggucccgggcgauuugguacauguggcugggagcaagauuccucgaguucgaagcccuuggcuuuaugaaugaggaucacugguucagcagggaaaacucucugucgggcguagagggggagggauuacauaaacuggguuauaucuugcgcgacauaucaaagaucccuggcgggaauauguacgcugaugacacggccggaugggauaccagaauuacugaagacgaucuccagaacgaggcaaaaaucacagacauuauggaaccagagcacgcucugcuagccaccagcaucuuuaagcuuacuuaucaaaauaaaguugugcggguccagaggcccgcuaagaacggcacagugauggaugugauaucccgucgagaccagcgcgguagugggcaggucggaaccuacggccugaauacauucacuaacauggaagcccaacucauuagacagauggagucugagggcaucuuuagcccuuccgaacuggagaccccaaacuuggcagaacggguuuuagauuggcuggagaaauaugggguggaaaggcucaagcgcauggcgaucucaggagacgacuguguagugaagcccauugaugacagauucgccacggcucuuaccgcccugaaugauauggguaaaguccggaaggacauaccgcagugggagccuaguaaaggcuggaacgauuggcagcaagugcccuuuugcucucaucacuuccaccagcuaaucaugaaggacgggagggagauuguugugccaugucgaaaucaggaugaacuggucggacgugcaagagugagccagggcgcugguuggucccuccgcgagacagccugcuuggggaaaucauacgcacaaauguggcagcugauguauuuucaucggagggaccuuagacuggccgcgaacgcuaucuguagcgccguaccuguugauugggugcccacuucucgcaccacaugguccauucacgcacaucaccaguggaugacuaccgaagacaugcucagugucuggaaucggguguggaucgaggaaaacccauggauggaggauaagacgcauauaagcucgugggaggacguucccuacuuaggaaagagggaagaccaauggugcggcucccugaucggcuugacagcccgagcuaccugggccacuaauauucagguggcaaucaaccaggucagacggcugauugggaaugagaacuaccucgauuucaugacaucuaugaaaagguuuaagaaugaaucagacaccgagggagcucuuugguga

SEQ ID NO: 13284 - RNA, 9879 nt, Artificial Sequence
  derived and/or modified CDS sequence (opt3) from DENV-1__FJ639677__SS-prME
agcgugaccaugcugcucaugcuuaugcccacagcacuggcuuuccacuugacuacgaggggaggggaaccucauaugaucgucuccaagcaggaaaggggaaagucuuuacuguuuaagaccucagccgguguuaacaugugcacacuaauugccauggaccucggcgaacugugugaagauacuaugaccuacaaaugcccacgggugacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauacagaggguugaaacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagggauuuuguagagggucuuaguggcgcgacuuggguugacguggucuuggagcacggguccugugugacaaccauggcaaaggauaaacccacucuggacauugaacuacucaagacagaggugaccaacccugccguccugaggaaacuuugcaucgaagcuaagauuucuaauacgaccacagauagccgguguccaacucaaggagaggccacccugguugaagaacaggacgcaaacuucgugugccgccgaacauuuguagauagaggcugggguaauggguguggauuguucggcaaaggcucccucaucacuugcgcuaaguuuaagugcgugaccaaacuggaggggaagauaguccaguacgaaaacuuaaaauauucagugauuguuacagugcacaccggagaccagcaucaagucgguaaugagaguacugaacacggcacgacagccaccaucacuccccaggcgccuaccacagagauucagcugaccgacuacggggcccucacucuugauuguagcccaaggacaggacuggacuucaacgaaaugguguugcuaacgaugaaggagaaaucuuggcugguacauaagcagugguuucucgaucugccgcuucccuggaccuccggcgcaucaacuagccaagagacauggaaucggcaggaccuguugguuaccuucaaaacagcucacgccaagaagcaggaaguggucgugcucgguagucaagagggggcuaugcacacugcccugaccggcgcaacggaaauccagaccucuggaacaacuaccaucuuugccggccauuuaaaaugccgucugaagauggauaaacuaacacucaaggggauguccuaugucauguguacugggucguucaaacuggagaaggaaguggcugagacccagcacgguacgguucuugugcagauuaaguacgagggcacagacgcgccuugcaaaauaccauucucgacccaagaugaaaaggggguaacucagaacggacgcuugaucacagcaaaucccauugucaccgacaaagagaagccugugaacaucgaagccgagccacccuuuggcgagucuuauauaguuauuggugcuggggaaaaagcccugaagcucuccugguucaagaaaggcucaaguaucggaaagauguuugaggcaacugccagaggcgcuaggcggauggccauccugggggauaccgcaugggacuucggaagcauugguggcguguuuacauccgucgggaaacuugugcaucagaucuucggaacggcguacggcguacuguuuucuggugugagcuggaccaugaagauugggauaggcguuuugcucacuuggcugggauuaaauucacgaaguacaucccugagcaugaccuguaucgcugucggccuagugacacucuaccugggggugaugguccaggccgauucuggaugcguuauuaacuggaaaggccgcgaacuuaagugugguucagggaucuucgugacuaaugaggugcacaccuggacggaacaauauaaguuucaggcagacaguccgaaaagauugagcgccgcuaucggaaaggccugggaggagggcguaugcgguauuagguccgcaacacggcuggaaaacauaauguggaaacagaucucuaacgagcucaaucauauucuguuagaaaacgacaugaagcugaccgucgugguuggcgauguggcugggauccuugcccagggcaagaagaugauucgcccucaacccauggaguacaaauauucguggaaaagcuggggcaaggcgaagaucauaggggccgacgcucagaauacuaccuucaucauugauggaccaaacacaccugaaugucccgacgaucagagagcauggaauaucugggaggucgaggacuacggcuuugguauuuucacuaccaacaucugguugaagcucagggauuccuauacacaggugugcgaccaccgucugaugucagccgcuauaaaagauaguaaggccguucacgcagacaugggguacuggauugaaucugagaaaaaugaaacguggaagcuagcgcgggccagcuuuaucgaggugaagaccuguauuuggccaaaaucccauacucuguggucaaacggaguacucgaaagcgagaugaucauacccaagaucuauggcgguccuauuucucaacacaauuaccgaccaggcuacuucacacagaccgcugggccguggcaucugggaaaacuugaguuggauuucgaccugugcgaaggcacuacagucgugguggaugagcacugcgggaacagaggacccuccuuaaggaccacgacugucaccggcaagaucauucacgaaugguguugccgcaguuguacacucccuccacugcgguuuagaggugaggacgggugcugguauggaauggagaucaggcccguuaaagaaaaggaggaaaaucuugugaaguccaugguaucugccggcuccggugagguggacucauucagucugggcuugcucuguauaagcauuaugaucgaagaggucaugcgcucgcgauggucccggaaaaugcugaugaccgggacucuagcaguguuuuuccugcucaucaugggacagcugacauggaacgaucuuauucguuugugcaucaugguuggcgcuaaugccucugacagaauggggaugggaaccacauaccuggcauuaauggccacuuuuaagaugaggccuauguucgcuaugggccuccuguuucgccggcuuaccagcagagaggugcugcuacucacgauuggucugucauuggucgcgaguguggaacugccaaacuccuuagaggaacucggggauggacuggccaugggcauaaugauccuuaaacuguugacagacuuccaaucucaucagcucugggcaacccugcuaagccugacuuuuauuaagaccacauucucccuucacuaugcuuggaaaacuauggccaugguucucucaaucgugagccuguuucccuugugucugaguaccacgucucagaagacaaccugguuaccgguccuccugggcucccuugggugcaagccucugacuauguucuugauugccgagaauaaaaucuggggaagaaagagcuggccacucaacgaagguauaauggcuguaggcaucgugucgauucugcuaucaucucugcuuaaaaacgauguuccccucgcagggccucugaucgccggaggcauguugauugcguguuacgugaucagugguuccagcgcugacuuaucucuggagaaggccgcagaggucagcugggaagaggaagccgagcauuccggggcuucacacaauauacucguggaaguacaggaugacggaacaaugaaaauuaaggaugaggagcgagacgauacccugacuauccuucugaaagcaacauugcuagccgugaguggcgucuauccccugagcaucccagcgacccucuuuguuugguacuucuggcaaaagaagaaacagcgcucuggcgugcugugggacacgccuucacccccagaaguggagcgggcuguccuugaugacgggauuuauagaauaaugcagaggggauuacugggucguagccaggugggcguugggguauuccaagaaaacguguuucauacuauguggcacgucacccgcggagccgugcucauguaccagggcaagcgguuggagccgaguugggcaagcguuaaaaaggaccugaucuccuacggugggggauggagacucaaaggcucuuggaauacaggcgaggaagugcaggucauugccguggagccugggaagaaccccaagaauguacagaccgcuccaggaacauucaaaacucccgaaggugaggucggcgccaucgcacuggauuuuaagccugggaccucgggaagcccaauugugaacagggaaggcaaaaucguuggucuuuaugggaauggaguggucacgacaucaggcacuuacguguccgcuauagcccaagcgaaggccagucaggagggcccccugccugagaucgaagacgagguuuuccgaaaacggaacuugaccauuauggaucuacacccggggucuggaaagacacgcagauaucugccagcaaucgugagggaagcuauuaagcggaaacuccgaaccuuaauccuggcccccacuagagucguggcuagcgagauggcagaagcccuuaaggguaugccuauacgcuaccagaccacagccguaaaauccgagcauacgggcaaggagauuguggaccugaugugccacgcuacuuuuaccaugaggcucuugucaccaguucguguccccaauuauaacaugaucaucauggaugaagcgcauuucacagacccuucuagcauugcagcccggggguacaucaguaccagagugggaaugggcgaggcugccgcaauauuuaugacugccacaccgcccgguuccguggaggcuuucccacaaagcaaugcggucauucaggaugaggaaagggacaucccugagcgcucuuggaacucaggguaugaguggauuaccgauuuucccggaaaaacgguaugguucgugccauccaucaagaguggcaaugacauagccaacugucugcgaaagaauggcaaaagaguuauucagcucagccggaagacuuuugauacagaauaccagaaaaccaagaacaacgacugggacuacguggucaccacugauaucucggagaugggggcaaauuucagggcugaccgcgugaucgauccucguagaugccugaaacccguuauucuuaaggacggaccagaacgggugauccuagccgguccgaugccugucacaguggcaucugccgcucaaaggcgcggccgaauugggagaaaccacaauaaggagggagaucaguauauauacaugggccagccccugaacaaugacgaggaucaugcccacuggaccgaagcgaaaauguuguuagacaacaucaauacaccagaggguauuauccccgcacuguucgaaccugagcgggaaaaguccgccgcuaucgauggggaguauaggcuccgcggcgaggccagaaaaacuuuuguagaacugaugaggcggggagaccuuccaguguggcugagcuacaagguugcuucagagggcuuccaguauagugaucgucgcuggugcuuugacggggaacgaaacaaucaaguccucgaggaaaacauggauguggagauuuggacgaaagagggagaaagaaagaaauugaggccccgguggcuggacgcacgcaccuacucugacccucuagcccugagagaguucaaggaauuugcugccgguaggcgguccgugagcggcgaucucauacuugagaucgggaagcugccgcagcacuuaacacagcgagcacagaaugcguuggacaaccuggucaugcuccauaauucagaacaaggaggcagagccuaucgccacgcuauggaggagcugccagauacuauugaaacccuuaugcugcucgccuugaucgcaguucugacagguggggugaccuuauucuuucuaaguggcaggggacugggcaaaacuagcauugggcuccuuuguguaauggcuuccucugugcuguuguggauggccagcgucgagccccauuggaucgcagccuccauaauccuggaguucuuucucauggugcugcuuauuccugagcccgaccggcagcguacgccacaggauaaccagcucgcuuacguugugaucggacuguuguucaugauucugaccgucgcggccaaugagauggguuuacuagaaacaacuaagaaagaccugggcaucgggcacguagcaguggagaaccaccaucacgcugccaugcucgauguugaccuucauccugccucagcauggacccuguacgcuguggccacaaccauaauuacucccaugaugagacacacaaucgaaaacacgaccgcgaauauuucuuugacugcuaucgccaaccaagcagccauacugaugggacucgauaagggcuggccaaucaguaaaauggacauuggugucccucugcuugcuuuagggugcuauagccaggugaauccgcugacacucaccgcagccgucuugaugcugguggcgcauuacgcuaucauuggccccggacuacaggccaaggcaaccagggaggcccaaaagcgcacagcugccggcaucaugaaaaacccaacuguugaugggauaguggcaauugaccuggauccuguaguguaugacgcuaaguuugaaaaacagcucggacagaucaugcuucugaucuuguguacgagccagauucugcucaugcggaccacaugggcccugugcgaguccaucacuuuagcgaccggcccccuuacaacccugugggaggguucuccagggaaguucuggaauacuacgauagccgucucaauggcaaacauuuuucgaggaagcuaccucgcuggcgccggucuagcauucucccugaugaaaaguuugggcgggggaagaaggggcacaggggcucaaggagaaacccugggcgagaaguggaagcgccagcucaaucagcuuucuaaaagcgaguucaacacuuauaagcggucagguaucauggagguugacagauccgaagccaaagaggggcugaagcguggagagaccacaaaacacgccgugaguaggggcacugcgaaguugcggugguuugucgaacgcaaucuggugaagccugaggguaaaguaauugaucucggcugugggcgaggaggcuggagcuacuauugcgcuggguuaaagaaagugaccgaaguuaagggauacacaaaaggcggucccgggcacgaggaaccgaucccaauggcaacguacggauggaaccuggugaaacuucauucuggcaaagacgucuucuuuauaccucccgagaagugugauacccugcuaugcgacaucggcgaguccucaccaaaucccacuauugaagaggggagaacacucagggugcugaagauggucgaaccuugguugcggggaaaccaguucuguaucaaaauucugaauccguauaugcccagcgugguugagacccucgagcaaaugcagcgcaagcacgguggcaugcuuguaagaaacccacugucgagaaauucuacucaugaaauguacugggugaguugcgggacaggaaacaucgucuccgccgugaauaugaccagccgaauguuacugaaccgguuuacgauggcucaccguaaaccuaccuaugagagagauguugacuugggcacagguacucgccacguggccgucgaacccgagguggcaaaccucgauauuaucgggcagaggauagaaaauauuaagcaugagcacaaaucaaccuggcauuacgacgaggauaacccuuauaagacaugggccuaccacggauccuaugaaguaaagccaucuggcagcgcuaguuccauggugaauggcguugucaaacugcuaacuaagcccugggacgugaucccuauggugacccagaucgcgaugacagauaccacuccauucgggcaacagcgggucuuuaaagagaagguugacacgagaacacccaaagccaagcgcggaaccgcacagauuauggaagugacugcuagguggcuuugggguuuccugagccgaucuaagaaaccgcggauauguaccagagaggaauuuaucaggaagguacgcucaaacgccgcaauuggcgccguguucgucgacgagaaucaauggaacagugcuaaagaggccguggaagaugagcguuuuugggaccucguucaucgggaaagagagcugcacaagcaggggaaaugcgcgacaugcguguacaauaugaugggaaagagggaaaagaaauugggcgaguucgguaaggcaaaagggucccgcgccaucugguacauguggcugggagcucgauuucucgaguucgaagcccuuggcuucaugaacgaggaucacugguuuagccgggaaaauucucugucgggcgucgagggggagggauuacauaagcuggguuauauuuugagagacaucucaaaaauaccuggcgggaacauguacgcagaugacacggcuggaugggauaccaggaucacugaagacgaucuccagaaugaggccaagauuacagacaucauggaaccagagcacgcucugcuagccaaagcaauuuucaaacuuaccuaucagaacaaggugguacgcguucaaagacccgcgaaaaauggcacugugauggaugucaucagccggagggaccagcgugguuccggacaggugggaacauacggccugaacaccuuuacaaauauggaagcccagcucauacgacaaauggagagugagggcauuuucucuccuagcgaacuggagacuccaaacuuggcugaacgcgccuuagauuggcuggagaaguaugggguggaaagacucaaacggauggcaaucuccggagacgacugugucguuaagcccaucgaugacagguuugcuaccgcccuuacggcacugaacgauauggguaaagugcgcaaggacauuccgcagugggagccuucaaagggcuggaaugauuggcagcagguacccuucugcagucaucacuuucaccaacuaauaaugaaagacgggagagagaucguggucccaugucggaaccaggaugaacuggugggaagggcccgaguuucucagggcgcggguuggagccuccgugagaccgcuugcuuggggaaguccuacgcccagauguggcaacugauguauuuccauagacgcgaccuucggcuggcagccaaugcuauuuguucagccgugccugucgauugggugcccacaagcaggacuaccuggucuauccacgcacaucaccaguggaugacaacugaagacaugcucuccguauggaacagaguuuggauugaggaaaauccauggauggaggauaaaacccauaucaguagcugggaggacgugcccuacuuaggaaagcgcgaagaccaguggugcggcucgcugauaggcuugacggcucgggccacaugggcgaccaacauccaagucgcuauuaaucaggugaggcgacugaucgggaacgagaauuaccucgauuauaugacuuccaugaaaagauuuaagaacgaaucugacccugagggagcccuuugguga

SEQ ID NO: 13285 - RNA, 9879 nt, Artificial Sequence
  derived and/or modified CDS sequence (opt3) from DENV-1__GQ868618__SS-prME
agcgugaccaugcugcucaugcuuaugcccacagcccuggcuuuccacuugacuacgagaggaggggaaccucauaugaucgucuccaagcaggaaagggggaaaucuuuacuguuuaagaccucagccgguguuaauaugugcacacuaauugccauggaccucggagaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuuacaguagucgugggcgauguugcugggauuuuagcccagggcaagaagaugauccgcccucaacccauggaguacaaauauagcuggaaguccuggggcaaggcgaaaauaaucggggccgacgugcagaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaagauucuaaggcuguucacgccgacaugggguacuggaucgaaagcgagaaaaaugaaacauggaagcucgcacgggcguccuucauugaggugaagacguguaucuggccaaaaucacauacccuguggagcaacggaguacuagaaucugagaugauaauccccaagauuuauggcgguccuaucucccaacacaauuaccgaccaggcuacuuuacucagacagccgggccguggcaucugggaaaacucgagcuggauuucgaccuuugcgaaggcaccacugucgugguggaugagcacugcgggaacagaggacccaguuugaggacaaccacggucacuggcaagauuauccacgaaugguguugccgcagcuguacccugccuccauuacgguuuaaaggugaggacgggugcugguauggaauggagauaagacccguuaaggaaaaggaggaaaaucucgugaaaucuaugguauccgcuggcucaggugagguggacaguuucagccugggccuucuguguauuucgaucaugaucgaagaggucaugaggucccgcuggucucgaaagauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaaaaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaagcugcuuacggacuuccaaagccaucagcugugggccacauugcucucccugaccuuuaucaaaacuaccuucucacuacacuaugcauggaagacaauggcuauggugcugagcauugucagucuuuuuccccucugucugucuacuaccucccagaagacgacaugguugccgguacuguuaggcagccucgggugcaaaccucugaccauguuccuuaucgccgagaauaagauauggggaagaaaaucguggccacugaacgaagguaucauggccgugggcauuguuucaaucuugcucucuagucugcuaaagaacgaugugccccuggcugggccucuuauugcaggaggcaugcucaucgccuguuacgucauauccgguagcucugcggaccugagcuuggagaaagcugccgagguguccugggaagaggaagcagagcauucaggggccagucacaauauuuuaguagaagugcaggaugacggaacuaugaagaucaaagaugaggagagggacgauacacugaccauccuccugaaggcuacucuucuggcagucagcggcguuuaucccuugucuauuccagccacacuauucgugugguacuuuuggcaaaagaaaaagcagcgauccggcgugcugugggacaccccuucacccccagaagucgagcgcgcggugcucgaugacgggauauaucggaucaugcagagaggacugcuugguaggagucagguuggcguagggguguuccaagaaaacgucuuucauacgauguggcacgugacucguggagcuguuuuaauguaccagggcaaacgccuggagccgagcugggccuccgugaagaaagaccucauuucuuacggugggggauggcgguugcagggcucguggaauaccggcgaggaaguccaggugaucgcaguagagccugggaagaaccccaagaauguccaaacagccccaggaaccuucaaaacaagcgaaggugaggugggcgcuauugcccuggauuuuaagcccgggacuucaggauccccuaucguuaacagagaaggcaaaauagugggucucuaugggaauggagucgugaccacgaguggcacauacguuucugcaaucgcucaggccaaggcgagccaggagggcccacugcccgagauugaagacgagguguucaggaaacgaaaccuuacuaucauggaucugcacccuggguccggaaagacccggcgcuauuugccggccauugucagagaagcaaucaagaggaaacuacggacacugauacucgcuccaacccgagugguagccucagagauggcugaagcauuaaaggguaugcccauuagauaccaaacuaccgccgugaaaucugagcauacaggcaaggagaucguugaccugaugugccacgccacguuuacuaugcgccuucugagcccugucagggugccaaauuauaacaugaucauuauggaugaagcucauuucaccgaccccaguuccaucgcggcacguggguacauaagcacacgggugggaaugggcgaggccgcugccauuuuuaugaccgcaacuccuccggguucugucgaagccuucccccagucaaaugcuguaauccaggaugaggaaagagacauuccagagagguccuggaacaguggguaugaguggaucacagauuuuccuggaaaaaccgugugguucguucccagcauaaagucgggcaaugacauugcgaacugucuccgcaagaauggcaaacgagugauccaguugucuagaaagacguucgauacugaauaccagaagacaaagaacaacgacugggacuacgucgugaccaccgauaucuccgagaugggggccaauuuucgggcagacaggguuauugauccacgccguugccugaaaccugugauccucaaggacggacccgaaagagucauucuggcugguccaaugccggugacuguagccagcgcagcccagcggaggggccgcauagggcgaaaccacaauaaggagggagaucaguauaucuacaugggccagccucuuaacaaugacgaggaucaugcucacuggacagaagccaaaaugcuacuggacaacauuaauacccccgaggguaucaucccagcguuguucgaacccgagagagaaaagucagcagccauugauggggaguaucgguuaaggggcgaggcucgcaaaacauuuguggaacugaugagaaggggagaccucccuguuuggcugaguuacaaggucgccucugagggcuuccaauauuccgaucggcguuggugcuuugacggggaacgcaacaaucaggugcuugaggaaaacauggauguggagauauggacuaaagagggagaacgaaagaaacugagaccaagguggcucgacgcucggacguacagcgaccccuuggcacugcgcgaguucaaggaauuugccgcugguagaaggucagucaguggcgaucuaauccuggagauugggaagcucccucagcaccuuacccagcgggcccaaaaugcacuggacaacuuaguuauguugcauaauagcgaacagggaggccgagcguauagacacgccauggaggagcugccggauacaaucgaaacucucaugcugcuugcucugauugccgugcucaccggugggguaacauuguucuuucuguccggccgcggauuaggcaaaaccucuaucgggcuacugugugugauggcaagcuccguccuccuuuggauggcuucaguggagccacauuggauagccgcaucuaucauucuggaguucuuuuugaugguucugcucauccccgagccugacaggcagcggacuccccaggauaaccaacuggccuacguggucauuggacuucucuucaugauccugacgguagcugcgaaugagauggguuugcuggaaaccacaaagaaagacuuaggcauagggcacguggccguugagaaccaccaucacgcagcuaugcuagauguggaccugcauccagccagugccuggacucucuacgcagucgcuaccacaauuaucaccccuaugaugcgucacacuauugaaaacacaacggccaauaucucgcuuaccgcgauagcuaaccaggccgcaauccugaugggauuggauaagggcuggcccauuagcaaaauggacaucggugugccacugcucgcccuggggugcuauucccaggucaauccucuuacuuuaacagcugcagugcugaugcucguugcccauuacgcgauuaucggcccgggauugcaagcuaaggccaccagagaggcacagaagaggaccgccgcuggcauaaugaaaaaccccacaguggaugggauuguagccaucgaccuggauccaguggucuaugacgcaaaguuugaaaaacagcuaggacagaucaugcugcucauucuuuguacuucucaaauccuguugaugcgcacgaccugggcucugugcgagucaauaacacucgccacuggcccucugaccacauuaugggaggguagccccgggaaguucuggaauaccacuauugcgguuuccauggccaacaucuuccggggaaguuaccuugcaggcgcuggucuggccuuuucucucaugaaaagccuaggcgggggacgaagaggcacgggggcacagggagaaacacugggcgagaaguggaagaggcaguugaaucagcugucaaaauccgaguucaacaccuauaagcgcagugguauuauggagguggaccggagcgaagcuaaagaggggcucaagagaggagagacuaccaaacacgccgucucucguggcacagccaaacuuaggugguuuguggaacggaaucugguaaagccagaggguaaagugaucgauuugggcugugggcgcggaggcugguccuacuauugcgcggggcugaagaaaguuacugaagugaagggauacaccaaaggcgguccugggcacgaggaacccauaccgauggcuacauacggauggaaccucgucaaguuacauucaggcaaagacguguucuuuaucccaccugagaagugugauacgcugcuuugcgacauuggcgagagcucgcccaauccaaccaucgaagaggggcgaacucugagaguccuaaagaugguggaacccuggcucaggggaaaccaauucuguauuaaaauccugaauccuuauaugccgucuguuguagagacauuggagcagaugcagcggaagcacgguggcaugcuggugcgcaacccccucaguagaaauuccacccaugaaauguacugggucagcugcgggacuggaaacauugugucagcaguuaauaugacauccaggaugcuucugaaccgauuuaccauggcccaccggaaaccaacguaugagcgugauguggacuuaggcgcugguaccagacacgucgccguggaaccugagguagcaaaccuggauaucauagggcagcgcauugaaaauaucaagcaugagcacaaaucuacauggcauuacgacgaggauaaccccuauaagacuugggccuaccacggaagcuaugaagugaagccuaguggcuccgcuagcucuaugguuaauggcgucgugaaauugcucaccaagccaugggacgugauccccauggucacacaaauugcgaugacugauaccacaccuuucgggcagcagaggguuuuuaaagagaagguggacacccggacuccaaaagccaagagaggaacggcacaaauaauggaaguaacagcuaaguggcugugggguuuccuaucacgcaacaaaaagcccaggaucuguacccgagaggaauuuacucggaaagugagaaguaaugccgcaauuggcgccgucuucguggacgagaaccaguggaacuccgcuaaggaggccguugaagaugagagguuuugggaccuugugcaucgcgaacgugagcugcacaaacaggggaagugcgcgaccugcgucuacaacaugaugggaaagcgggagaaaaagcucggcgaguucgguaaagcaaaggggagcagagccaucugguacauguggcugggagcuagguucuuggaguuugaagcccugggcuucaugaaugaggaucacugguuuucucgcgaaaacucgcucucaggcguggagggggagggacuucauaaacuggguuauauuuuacgagacaucagcaagauaccgggcgggaauauguacgcagaugacacagcuggaugggauacgcggaucaccgaagacgaucugcagaacgaggccaaaauuacugacaucauggaaccugagcacgcuuugcucgccaaguccauuuucaagcugacauaucaaaauaaaguaguuagagugcagaggccagcaaagaacggcaccgucauggaugugaucagucgcagagaccagcgggguucuggacaggugggaacuuacggccuaaauacauuuaccaacauggaagcgcaacuuauaaggcagauggagagcgagggcauuuucucccccucagaacuggagacaccuaaccucgccgaacguguccuggauugguuggagaaacaugggguugaacgauuaaagcgcauggcuaucaguggagacgacugugugguaaaaccaaucgaugacagauuugccacugcacugaccgcucucaaugauauggguaaggugcggaaggacauuccccagugggagccgucuaaaggcuggaacgauuggcagcaagucccuuucugcagccaccacuuucaucagcuuauaaugaaggacgggagggagaucgugguucccugucgcaaucaggaugaacuggugggcagagcacgggucucccagggcgcagguuggucacuaagggagacggccugccuggggaaaagcuaugcgcaaauguggcagcucauguacuuccaccgacgugacuugagacuggcugccaacgcaauuuguucugccgugccaguagauuggguuccuaccucccgcacaacuuggaguauccaugcucaccaucaguggaugaccacagaagacaugcuuagcguguggaaucgggucuggauugaggaaaaccccuggauggaggauaagacucacaucucguccuggggagacgugccauaucugggcaaaagggaggaccaauggugcggcucucucauaggguuaaccgccagagcaacgugggcuacaaauauccagguugccauuaaccaggugcgccggcugaucggaaaugaaaacuacuuggauuacaugaccucaaugaagagguuuaagaaugagagcgaccccgaaggugcgcugugguga

SEQ ID NO: 13286 - RNA, 9879 nt, Artificial Sequence
  derived and/or modified CDS sequence (opt3) from DENV-1__GQ868619__SS-prME
agcgugacaaugcugcucaugcuuaugcccacagcacuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuugcccagggcaaaaagaugauccgcccucaacccauggaguacaaauauucguggaaaagcuggggcaaggcgaaaauaaucggggccgacgcucagaauacuaccuucauuaucgauggaccaaacacaccugaaugucccgacgaucagagagcauggaauauuugggagguggaggacuacggcuuugguaucuucacuaccaacauaugguugaagcucagggauuccuauacacaggucugcgaccaccgucugaugucagccgcuauuaaagauaguaaggccgugcacgcagacaugggguacuggaucgaaucugagaaaaaugaaacguggaagcuagcgcgggccagcuuuauugagguuaagaccuguaucuggccaaaaucccauacucuguggucaaacggagugcucgaaagcgagaugauaauccccaagauuuauggcgguccuaucucucaacacaauuaccgaccaggcuacuucacacagaccgcugggccguggcaucugggaaaacuugaguuggauuucgaccugugcgaaggcacuacaguagucguggaugagcacugcgggaacagaggacccuccuuaaggaccacgacugugaccggcaagauuauccacgaaugguguugccgcaguuguacacucccuccacugcgguuuagaggugaggacgggugcugguauggaauggagauaaggcccgucaaagaaaaggaggaaaaucuuguuaagagcauggugucugccggcuccggugagguagacucauucagucugggcuugcucuguauuagcaucaugaucgaagaggugaugcgcucgcgauggucccggaaaaugcugaugaccgggacucuagucguguuuuuccugcucauuaugggacagcugacauggaacgaucuuauccguuugugcauuaugguuggcgcaaaugcuucugacagaauggggaugggaaccacauaccuggccuuaauggcaacuuuuaagaugaggccuauguucgccgugggccuccuguuucgccggcuuaccagcagagagguccugcuacucacgauaggucugucauugguggcuaguguugaacugccaaacuccuuagaggaacucggggauggacuggcgaugggcaucaugauucuuaaacuguugacagacuuccaaucucaucagcucugggccacccugcuaagccugacuuuuaucaagaccacauucucccuucacuaugcauggaaaacuauggcuauggugcucucaauugucagccuguuucccuugugucugaguaccacgucucagaagacaaccugguuaccgguacuccugggcucccuugggugcaagccucugacuauguucuugaucgccgagaauaaaauauggggaagaaaguccuggccacucaacgaagguaucauggccgugggcauuguuucgauccugcuaucaucucugcuuaaaaacgaugugccccucgcugggccucugauugcaggaggcauguugaucgccuguuacgucauaagugguuccagcgcggacuuaucucuggagaaggcugccgaggugagcugggaagaggaagcagagcauuccggggccucacacaauauucucguagaagugcaggaugacggaacaaugaaaaucaaggaugaggagcgagacgauacccugacuauccuucugaaagcuacauugcuagcagucaguggcguuuauccccugagcauuccagccacccucuuugugugguacuucuggcaaaagaagaaacagcgcucuggcgugcugugggacacgccuucacccccagaagucgagcgggcggugcuugaugacgggauauauagaaucaugcagaggggauuacugggucguagccagguuggcguagggguguuccaagaaaacgucuuucauacuauguggcacgugacccgcggagcuguucucauguaccagggcaagcgguuggagccgaguugggccagcgugaaaaaggaccugauuuccuacggugggggauggagacuccagggcucuuggaauacaggcgaggaaguccaggugaucgcaguagagccugggaaaaaccccaagaauguccaaaccgccccaggaacauucaagacucccgaaggugaggugggcgcuauugcccuggauuuuaaaccugggaccucgggaagcccaaucguuaacagggaaggcaagauagugggucuuuaugggaauggagucgugacgacaucaggcacuuacguuuccgcaaucgcucaggccaaagcgagucaggagggcccccugccugagauugaagacgagguguuccgaaagcggaacuugaccaucauggaucuacacccggggucuggaaaaacacgcagauaucugccagccauugucagggaagcaaucaagcggaagcuccgaaccuuaauacuggcucccacuagagugguagccagcgagauggcugaagcacuuaaagguaugccuauucgcuaccaaaccacagccgugaaguccgagcauacgggcaaagagaucguugaccugaugugccacgccacuuuuaccaugaggcucuugucaccaguccgugugcccaauuauaacaugaucauuauggaugaagcucauuucacagacccuucuagcaucgcggcacggggguacauaaguaccagagugggaaugggcgaggccgcugccauuuuuaugacugcaacaccgcccgguuccauggaagccuucccacagagcaaugcugucauccaggaugaggaaagggacauuccugagcgcucuuggaacucaggguaugaguggaucaccgauuuucccggaaagacgguaugguucgugccauccauaaaaaguggcaaugacauugcgaacugucugcgaaagaauggcaagagaguuauccagcucagccggaaaacuuuugauacagaauaccaaaagaccaaaaacaacgacugggacuacguggucaccacugauaucucggagaugggggccaauuucagggcagaccgcgugauugauccucguagaugccugaagcccaucauucuuaaagacggaccagaacggguuauacuagcugguccgaugccugugacagucgccucugcagcccagaggcgcggccgaaucgggagaaaccacaauaaggagggagaucaguauauuuacaugggccagccccugaacaaugacgaggaucaugcucacuggaccgaagccaagauguuguuagacaacaucaauacaccagaggguaucauucccgcgcuguucgaaccugagcgggaaaaauccgcagccauagauggggaguauaggcuccgcggcgaggcuagaaagacuuuuguggaacugaugaggcggggagaccuuccaguauggcugagcuacaaaguggccucagagggcuuccaauauagugaucgucgcuggugcuuugacggggaacgaaacaaucagguucucgaggaaaacauggaugucgagaucuggacgaaggagggagaaaggaaaaaguugaggccccgguggcuggacgcucgcaccuacucugacccucuagcacugagagaguucaaagaauuugccgcugguaggcgguccgugagcggcgaucucauucuugagaucgggaagcugccgcagcacuuaacacagcgagcccaaaaugcauuggacaaccuggugaugcuccauaauucagaacagggaggcagagcguaucgccacgccauggaggagcugccagauacuauugaaacccuuaugcugcucgcuuugaucgccguccugacaggugggguuauguuauucuuucuaaguggcaggggacugggcaagaccagcauagggcuccuuugugugauggcauccucuggacuguuguggauggcuagcguagagccccauuggaucgccgcauccauuauccuggaguucuuucucauggugcugcuuauuccugagcccgaccggcagcguacuccacaggauaaccaacucgccuacgucgugaugggucuguuguucaugauccugacgguugcugcgaaugagaugggcuuacuagaaaccaccaaaaaggaccuggggauaggacacguggccgucgagaaccaccaucacgcagcuaugcucgauguagaccuucauccugccucagccuggacucuguacgcaguggcuaccacaauuaucacccccaugaugagacacacuauugaaaacacaacggccaauaucucuuugaccgcgauagcuaaccaggccgcaauccugaugggccucgauaaagguuggccaauuaguaagauggacaucgggguuccucugcuugccuuaggcugcuauagccaggugaauccgcugacucucacagcugcagucuugaugcugguggcccauuacgcgauuaucggacccggccuacaagcuaaagccaccagggaggcacagaagcgcaccgccgcugggauaaugaagaacccaacagucgauggaauuguggccaucgaccuggauccuguuguguaugacgcaaaauuugaaaagcagcucggccagaucaugcuucugauuuuguguacuagccaaauccugcucaugcggacgaccugggcucugugcgaguccauaacauuagccacugguccccuuaccacacugugggaggggucuccaggaaaauucuggaauaccacuauugcgguaucaauggccaacaucuuucgaggcagcuaccucgcaggagcuggccuagccuucucccugaugaagagucuagggggaggcagaagggggacgggagcacagggcgaaacacugggugagaaauggaagcgccagcucaaucagcuuucuaagagcgaguucaacaccuauaaacggucagggauuauggagguggacagauccgaagcuaaggagggacugaaacguggcgagacuaccaagcacgccgucaguagggguacagccaaauugcggugguuuguugaacgcaaucuggugaagccugagggcaaggucaucgaucucggguguggacgaggcggguggagcuacuauugcgcgggacuaaagaaggugacugaaguaaaaggcuacaccaagggugggcccggacacgaggaaccgauaccaauggcuacauacggcuggaaccuggugaaacuucauucuggcaaggacguuuucuuuaucccucccgagaaaugugauacgcugcuaugcgacauuggggaguccucaccaaaucccaccaucgaagagggaagaacucucagggugcugaagauggucgaaccuugguugcgggguaaccaauucuguauuaagauccugaauccguauaugcccagcguggucgagacacucgagcagaugcagcgcaaacacggcgggaugcuugugagaaacccacugucgagaaauucuacccaugaaauguacuggguuaguugcggaacuggcaacauuguauccgcagugaauaugacaagccgaauguuacugaaccgguuuaccauggcccaccguaagccuacguaugagagagaugucgacuuggguaccgggacacgccacguggcuguugaacccgagguggccaaccucgauaucauaggacagaggauugaaaauaucaaacaugagcacaagucaacuuggcauuacgacgaggauaacccuuauaaaaccugggcauaccacggcuccuaugaagucaagccaucuggcagcgccaguuccauggugaaugggguagugaagcugcuaacaaaacccugggacguuaucccuauggucacucaaauugcuaugaccgauacaaccccauucggacagcagcggguguuuaaggagaaaguggacacuagaacgcccaaggcgaaacgcgguacagcccaaauaauggaagucaccgcaagguggcuuuggggcuuccugagccgaaacaagaagccgcggaucuguacuagagaggaauuuaccaggaaaguucgcucuaaugcugccauuggggcaguguucguagacgagaaccaguggaacucagccaaggaggcuguggaagaugagcguuuuugggaccucguccaucgggaaagagagcugcacaaacagggaaagugcgccacaugcguguacaacaugaugggcaaaagggaaaagaaguugggugaguucgggaaagcgaagggaagucgcgcaaucugguacauguggcugggcgcccgauuucucgaguucgaagcucuuggcuucaugaaugaggaucacugguuuucccgggaaaacagccugucugggguugagggagaggguuuacauaaacugggcuauauuuugagagacaucucgaagauaccugggggaaauauguacgccgaugacacggcaggcugggauaccaggaucacugaagacgaucuccagaacgaggcuaaaauuacagacaucauggaaccagagcacgcccugcuagcuaaggccauuuucaaacuuaccuaucaaaauaaggugguccgcgugcagagacccgcaaagaacgguacuguaauggauguuaucucacggagggaccagcgugggagcggacaggugggcacauacggccugaauaccuuuacaaacauggaagcgcaacucauacgacagauggaguccgaggggauuuucaguccuucugaacuggagacuccaaacuuggccgaacgcgcuuuagauuggcuggagaaauauggagucgaaagacucaagcggauggccaucagcggugacgacuguguggugaaacccaucgaugacagguuugcaaccgcucuuacggcccugaaugauaugggcaagguccgcaaagacauuccgcagugggagccuuccaagggguggaacgauuggcagcaaguucccuucugcucacaucacuuucaccagcuaauaaugaaggacggaagagagaucgugguaccaugucggaaucaggaugaacuggugggcagggcacgagucagucagggugccggguggucucuccgugagaccgcgugcuugggaaaaagcuacgcucaaauguggcagcugauguauuuccauagacgcgaccuucggcuggccgcaaacgccauuuguuccgcugugccuguugauugggugcccacaucaaggacuaccuggagcauccacgcccaucaccaguggaugacaacugaagacaugcucucugucuggaauagaguguggauugaggaaaacccauggauggaggauaagacccauaucuccaguugggaggacguacccuacuuaggcaaacgcgaagaccaauggugcggcagccugauaggguugacggcacgggcuacaugggccaccaauauccagguugcgauuaaccaggugaggcgacugaucggaaaugagaacuaccucgauuauaugacuucgaugaagagauuuaaaaaugaauccgacccugagggugcucuuugguga

SEQ ID NO: 13287 - RNA, 9879 nt, Artificial Sequence
  derived and/or modified CDS sequence (opt3) from DENV-1__FJ639678__SS-prME
agcgugaccaugcugcucaugcuuaugcccacagcccuggcuuuccacuugacuacgagaggcggggagccucauaugaucgucuccaagcaggaaaggggaaaagcauuacuguuuaagaccucugccgguguuaacaugugcacacuaauugcgauggaccucggcgagcugugugaagauacuaugaccuacaaaugcccacggauaacagagguggaaccggacgauguagacuguuggugcaaugcuaccgauacuugggugacauaugggaccuguccccaaacgggagagcaccgccgagaccguagaucagucgcccuugcaccucaugugggccuggguuuggagacuagggccgaaaccuggaugaguagcgagggggcuuggaagcagauccagcggguugaaacaugggcacuccgccacccaggauucacugugauugcccuguuucuggcucaugccaucggcaccuccauuacacagaaaggcaucauauucauccucuuaaugcuggucacccccucuauggcgaugagaugcguggggauuggaaacagggauuuuguagagggucuuucgggcgcaacguggguugacguggucuuggagcacgggucaugugugacuacaauggccaaggauaagccuacccuggacaucgaacuacucaaaacugaggugacaaauccagcuguccugcggaagcuuugcauugaagccaaaaucagcaacaccacgaccgauagucgcugucccacacaaggagaggcaacucugguugaagagcaggacgcuaauuucgugugccgaagaaccuuuguagauaggggcugggguaacggguguggauuguucggcaagggcucccucauaacaugcgccaaauuuaagugcgugacuaagcuggaggggaaaauuguccaguacgaaaauuuaaaguauucugugaucguuaccgugcacacaggagaccagcaucaagucgguaacgagagcaccgaacacggcacuacggcgacaauuaccccucaggccccaacuuccgagauccagcugaccgacuacggggcacucacacuugauuguucaccgcggaccggacuggacuucaaugaaaugguguugcuaacuaugaaagagaagaguuggcugguacauaaacagugguuucucgaucugccccuuccuuggacaagcggcgcuucuacgucccaagagaccuggaaccgucaggaccuguugguuacuuucaagacagcccacgcuaaaaagcaggaaguggucgugcucgguucacaagagggggccaugcacaccgcacugacaggcgccacugaaauccagaccagcggaacgaccacaauuuuugcuggccauuuaaagugccgccugaaaauggauaagcuaacucucaaagggaugaguuaugucauguguaccggaucuuucaagcuggagaaagaaguggcggagacacagcacgguacuguucuugugcagauaaaguacgagggcaccgacgcaccaugcaagauccccuucuccacgcaagaugaaaaagggguaacacagaauggaagauugauuaccgccaacccuaucgucacugacaaggagaaaccagugaauauagaagcugagcccccguuuggcgagagcuauauuguuaucggugccggggaaaaggcacugaaacucucgugguucaagaagggcucuuccaucggaaaaauguuugaggccacagcuaggggcgcccggcgaauggcaauucugggggauaccgcgugggacuucggaucaaucgguggcguguuuacuagugucgggaagcuugugcaucagauuuucggaaccgcuuacggcguacuguuuagcgguguguccuggacaaugaaaauagggaucggcguuuugcucacguggcugggauuaaacucucgcagcaccucacugaguaugacuuguauugccgucggccuagugacacucuaccugggggugaugguccaggcagauuccggaugcguuaucaauuggaagggcagagaacuuaaaugugguagcgggaucuucgugaccaacgaggugcacacauggacugaacaauauaaguuucaggccgacucuccuaagagguugucagcugccauuggaaaagcaugggaggagggcguaugcgguauacggagugcuacccgccuggaaaacaucauguggaagcagauuagcaaugagcucaaccauauccuguuagaaaaugacaugaaauucacggucgugguuggcgauguggucgggauucuggcccagggaaagaaaaugaucagaccccaaccaauggaguacaaguauuccuggaaaucuuggggcaaggcgaagauaaucggggccgacauucagaacacaaccuuuaucauugauggaccuaauacucccgaauguccagacgaucagagggcuuggaacaucugggagguggaggacuacggcuucgguauauuuaccacaaauauuuggcuuaaauugcgugauucguauacucagguuugcgaccaccggcucaugagcgcagccaucaaggauuccaaagcugugcacgccgacaugggguacuggauugaaucagagaagaacgaaaccuggaaacuggcacgagcgaguuucaucgagguaaagacauguauauggcccaagucucauacgcuauggagcaauggaguccuggaauccgagaugaucauuccuaaaaucuauggcgguccaauuucacaacacaacuacagaccgggcuacuucacccagacugccgggcccuggcaucucggaaagcuggagcuugauuuugacuugugcgaaggcacaaccgugguggucgaugagcacugcgggaauaggggaccuagccugcgcacuacaaccguuacgggcaaaaucauacacgaaugguguugccggucuuguacuuuaccaccccucagauucaagggugaggacgggugcugguauggaauggagauuaggccugugaaagaaaaggaggaaaaccugguaaaguccauggugagugcuggcagcggugaggucgacucuuuuucccuuggccuguuguguaucucaaucaugauugaagaggugaugcgcagucgauggagccggaaaaugcucaugaccgggacacuggccguuuucuuucuacugaucaugggacagcucaccuggaaugaucugauucgucuuugcauaauggugggcgcaaacgcuucggacagaauggggaugggaacuacauacuuggcccugauggcaaccuucaagaugaggccaauguuugccgucggcuuacucuuccgccggcugacauccagagaggugcuucugcuaacuaucggucucucucugguugcuagcguggaauugcccaauucacuggaggaauuaggggauggacucgcgaugggcauuaugauccugaaacuucugaccgacuuucaaagucaucaguugugggccacgcuccugucccuaacauucauuaagaccacuuuuucucugcacuaugcauggaaaaccauggcuaugguccuuagcaucguaucccuccugccguugugucugucaacaacuagccagaagaccacgugguuaccugugcuccugggcagucuugggugcaagccacugacaauguucuugauagccgagaacaaaaucuggggaaggaagucuuggccccucaacgaagguauuauggccguuggcaucguguccauucugcuaagcucgcugcuuaaaaaugaugucccucucgcugggccccugaucgcaggaggcauguugauagccuguuacgugauuucagguucuagugcggacuuaucccuggagaaggcugccgagguaagcugggaagaggaagcagagcauucuggggccagccacaacauccucguggaaguccaggaugacggaaccaugaaaaucaaggaugaggagcgagacgauacucugacaauucuucugaaagcuaccuugcuagcaguuuccggcguguauccacugucaauaccugccacucucuuucugugguacuucuggcaaaagaagaaacagcgcaguggcgugcuuugggacacacccagcccaccggaagucgagcgggcgguguuagaugacgggaucuauagaauuaugcagaggggacugcucggucguucucagguuggcguagggguguuccaagaaaaugucuuucauaccauguggcacgugacgcgcggagcuguuuugauguaccagggcaagcggcuggagccuuccugggccucagugaaaaaggaccucaucaguuacggugggggauggagacugcagggcagcuggaacacuggcgaggaaguccaggugauugcaguagagcccgggaaaaauccaaagaacguccaaaccgcccccggaacauucaagaccccugaaggugaggugggcgcuaucgcccuugauuuuaaaccagggacauccggaucucccauaguuaauagggaaggcaagaucgugggucuguaugggaacggagucgugacuaccucgggcacguacguuagcgcaauugcucaggccaaagcgucacaggagggcccuuugccggagaucgaagacgagguguuccgaaagcggaaucuaacaauuauggaucugcacccaggguccggaaaaacucgcagauaucuccccgccaucgucagggaagcaauaaagcggaaguuacgaacccugauucuugcuccuacaagagugguagccagugagauggcugaagcacugaaagguaugccaauccgcuaccaaaccacugccgugaagucugagcauaccggcaaagagaucguugaccucaugugccacgccacauuuacgaugagguugcugagccccguccgugugccuaacuauaauaugauuaucauggaugaagcucauuucacugacccguccucaauagcggcacggggguacauuucuaccagagugggaaugggcgaggccgcugccaucuuuaugacagcaacccccccagguagcgucgaagccuucccucagaguaacgcuguaauucaggaugaggaaagggacauccccgagcgcuccuggaauagcggguaugaguggauaacugauuuuccaggaaagacagugugguucguuccuucuauuaaaucaggcaacgacaucgcgaauugucuccgaaagaacggcaagagagugauccagcugucccggaaaaccuuugauacggaauaccaaaagacuaaaaacaaugacugggacuacgucgugacaaccgauauuagugagaugggggccaacuucagggcagaccgcguuaucgauccccguagaugccuuaagccagugauucuaaaagacggacaggaacgggucauacuggcugguccgaugccugugaccguagccagcgcagcccagaggcgcggccgaaucgggagaaaucacaacaaggagggagaucaguauauuuacaugggccaacccuugaauaacgacgaggaucaugcucacuggacugaagccaagauguuacuggacaauaucaacacaccagaggguaucauucccgcgcucuucgaaccugagcgggaaaaaucggcagccauagauggggaguauaggcugcgcggcgaggcuagaaagaccuuuguggaacuuaugaggcggggagaccugccaguuuggcucucuuacaaagucgccuccgagggcuuccaguauagcgaucgucgcuggugcuuugacggggaacgaaauaaccagguguuggaggaaaauauggauguggagaucuggacaaaggagggagaaagaaaaaagcugaggccccgguggcuagacgcucgcacuuacucagacccucuggcacucagagaguucaaagaauuugccgcugguaggcggagugucucuggcgaucuuauucuggagaucgggaaguuaccgcagcacuugacgcaaaaggcccagaacgcacuggacaaucucguuaugcugcauaacuccgaacagggaggccgagcguauagacacgccauggaggagcuuccagauaccauugaaacacugaugcucuuggcucugaucgccguguuaacuggugggguaacccuauucuuucugagcggccgcggacucggcaaaacaucaauagggcuucugugugugauggcaaguagcgcuuugcuguggauggccuccgucgagccccauuggaucgcagccucuauuauccucgaauucuuucugauggugcuucucauuccugagcccgacaggcagcggaccccacaagauaaucagcuggcuuacguugugaucggauugcuguucaugauauuaacugucgcggccaacgagaugggucuacuggaaacgaccaagaaagaccucggcauugggcacguagcaguggagaaccaccaucacgcuacaaugcuugauguugaccugcauccugccagcgccuggacuuuguacgcaguggcuaccacaaucauuacccccaugaugcgucacacuaucgaaaauacaacggccaacauaucccugaccgcgaucgcuaaucaggccgcaauucucaugggacuggauaagggcuggccaaucucaaaaauggacauuggugucccucuuuuagcccuggggugcuauucucaagugaacccgcucacuuugacagcugcaguccugaugcuaguggcccauuacgcgaucauaggccccggacugcaggcuaaggccaccagagaggcacagaagaggaccgccgcuggcauuaugaaaaauccaacaguugaugggaucguggccaucgaccucgauccuguaguguaugacgcaaaguuugaaaaacagcuuggacaaauuaugcuguugauccuguguacuagucagauacuccugaugcgcacgaccugggcuuuaugcgagucgauuacacuugccacuggcccccugaccacacucugggaggguagcccagggaaguucuggaacaccacuaucgcggucuccauggccaauauuuuucggggaucuuaccuagcaggcgcuggucuggccuucucauugaugaaaagccugggcgggggacgaagaggcacgggggcacagggagaaacacucggcgagaaguggaagaggcagcuuaaccaacuguccaaaagugaauucaauaccuauaagcgcucugguaucauggagguugaccggagcgaagcuaaagagggguugaagagaggagagacuacccgucacgccgugucaaggggcacagccaaacugcggugguuugucgaacgcaaccucgugaagccugaggguaagguaauagauuuaggcugugggcgaggaggcugguccuacuauugcgcggggcugaaaaaggugacugaaguuaaaggauacaccaagggcggucccgggcacgaggaaccgaucccaauggcuacauacggauggaaucuugugaaacugcauaguggcaaggacgucuucuuuauuccucccgagaaaugugauacgcuacucugcgacaucggcgagagcucuccaaaccccaccauugaagaggggagaacucugaggguguugaagauggucgaaccuuggcugcggggaaaucaguucuguaucaagauucucaacccguauaugcccuccgugguugagacacuugagcagaugcagcgcaaacacgguggcaugcugguaagaaauccauuaucaaggaacagcacccaugaaauguacugggugucgugcgggacuggaaauaucgucucugcagugaacaugacaagucgaaugcuguugaaccgguuuaccauggcccaccguaagccuacguaugagagagauguugaccucggcgcugguacccgccacguggccgucgaacccgagguggcaaaucuggauauaauugggcaaaggaucgaaaacaucaaacaugagcacaaguccacauggcauuacgacgaggauaauccuuauaaaacuugggccuaccacggaagcuaugaaguaaagccaucaggcuccgcuucuagcauggugaacggcguugucaagcuacuuaccaaacccugggacgugauuccuauggugacacagauagcgaugacugauaccacaccauucgggcagcaacgggucuuuaaggagaaaguugacaccagaacucccaaggccaaacagggaacggcacagaucauggaagugacagcucgcuggcugugggguuuccucaguaggaauaagaagccgcgaauuuguacccgggaggaauuuacuagaaaaguaagguccaacgccgcaaucggcgccguguucgucgacgagaaucaguggaacagcgcuaaggaggccguggaagaugagcgcuuuugggaccugguucaucgugaacgggaguugcacaaacaagggaagugcgcgaccugcguguacaauaugaugggaaaaagagaaaagaagcugggcgaguucgguaaagcaaaggggucuagggccauuugguacauguggcucggagcucgcuuucuugaguucgaagcccugggcuucaugaacgaggaucacugguuuucacgagaaaauaguuuauccggcgucgagggggagggacugcauaaauuggguuauauccuccgggacauaagcaagaucccuggcgggaacauguacgcagaugacacagcuggaugggauacgagaauuaccgaagacgaucugaggaaugaggccaaaaucacugacauuauggaaccagagcacgcucuacuugccacaucuaucuucaagcugaccuaucagaacaaagugguacgcguucagagacccgcaaagaauggcacugugauggaugucauaucgcggagggaccagcgugguucagggcaagugggaacauacggccucaacaccuuuacaaacauggaagcgcagcugauucgacagauggagagcgagggcaucuucuccccuagugaauuggagacuccaaauuuagccgaacgcgugcuggauuggcucgagaaguauggggucgaaagacuuaaacggauggcuaucucuggagacgacuguguugugaagcccauugaugacagguuugccaccgcacugacggcucuaaacgauauggguaaaguacgcaaggacauaccgcagugggagccuagcaaaggcuggaaugauuggcaacaggugcccuucugcucccaucacuuucaccagcugaucaugaaggacgggagagagauugucgugccaugucggaaccaggaugaacucguuggaagggcccgagugucacaaggcgcagguuggaguuugcgugagaccgccugccuggggaagucuuacgcgcagauguggcagcuuauguauuuccauagacgcgaccugcggcucgcugccaaugcaaucuguagcgccgucccuguggauuggguacccacauccaggacuaccuggucaauucacgcucaucaccaauggaugacaacugaagacauguuaagcguuuggaacagaguguggaucgaggaaaauccauggauggaggauaaaacccauauaucuuccugggaggacguccccuaccugggaaagcgcgaagaccaguggugcggcaguuugaucggccugacggcccgggcaacaugggcuaccaacauucagguggccaucaaucagguuaggcgacucauugggaacgagaauuaccuugauuauaugacuagcaugaaaagauuuaagaacgaaucggacccugagggagcgcugugguga

SEQ ID NO: 13288 - RNA, 9879 nt, Artificial Sequence
  derived and/or modified CDS sequence (opt3) from DENV-1__FJ639679__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccuggcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcuuaaguugagggauuccuauacacaggucugcgaccaccgucucaugucagcagccaucaaagauaguaaggcugugcacgccgacaugggguacuggauugaaucugagaaaaaugaaacguggaagcuggcacgggcgagcuucaucgagguuaagaccuguauauggccaaaaucccauacucuauggucaaacggagugcuggaaagcgagaugaucauucccaagaucuauggcgguccuauuucucaacacaauuaccgaccaggcuacuucacacagaccgccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggaaaaugcucaugaccgggacucuggccgucuuccuacugcucaucaugggacagcugacauggaacgaucuuauucguuugugcauaauggugggcgcaaaugcuucugacagaauggggaugggaaccacauaccuggccuuaauggcaacuuuuaagaugaggccuauguucgccguuggccuccuguuucgccggcuuaccagcagagaggugcugcuacucacgaucggucugucauuggucgcuaguguggaacugccaaacuccuuagaggaacucggggauggacuggcgaugggcauuaugauccuuaaacuguugacagacuuccaaucucaucagcucugggccacccugcuaagccugacuuuuauuaagaccacauucucccuucacuaugcauggaaaacuauggcuaugguucucucaaucgugagccuguuucccuugugucugaguaccacgucucagaagacaaccugguuaccgguccuccugggcucccuugggugcaagccucugacuauguucuugauagccgagaauaaaaucuggggaaggcgaagcuggccacucaacgaagguauuauggccguaggcaucgugucgauucugcuaucaucucugcuuaagaacgauguuccccucgcugggccucugaucgcaggaggcauguugauagccuguuacgugauuagugguuccagcgcggacuuaucucuggagaaagcugccgaggucagcugggaagaggaagcagagcauuccggggccucacacaauauccucguggaaguacaggaugacggaacaaugaagaucaaagaugaggagcgcgacgauacccugacuauucuucugaaggcuacauugcuagcagugaguggcgucuauccccugagcauaccagccacccucuuuguuugguacuucuggcagaagaagaagcagcggucuggcgugcugugggacacgccuucacccccagaaguggagagagcgguccuugaugacgggaucuauaggauuaugcagcguggauuacugggucgcagccaggugggcguugggguauuccaagaaaacguguuucauacuauguggcacgucacccggggagcugugcucauguaccagggcaaaagauuggagccgaguugggccagcguuaagaaagaccugaucuccuacggugggggauggaggcuccagggcucuuggaauacaggcgaggaagugcaggucauugcaguggagccugggaagaaccccaaaaauguacaaaccgccccaggaacauucaagacucccgaaggugaggucggcgcuaucgcccuggauuuuaagccugggaccucgggaagcccaauagugaaccgagaaggcaaaaucguuggucuuuaugggaauggaguggucacgacaucaggcacuuacguguccgcaauugcucaggccaaggcgagucaggagggcccccugccugagaucgaagacgagguuuuccggaaacgcaacuugaccauuauggaucuacacccggggucuggaaagacaagaagguaucugccagccaucgugcgggaagcaauaaaacgaaagcucagaaccuuaauucuggcucccacucgcgucguggccagcgagauggcugaagcacuuaaggguaugccuaucagguaccaaaccacagccguaaaauccgagcauacgggcaaggagaucguggaccugaugugccacgccacuuuuaccaugcgucucuugucaccaguucggguccccaauuauaacaugauuaucauggaugaagcucauuucacagacccuucuagcauagcggcaagaggguacauuaguaccagggugggaaugggcgaggccgcugccaucuuuaugacugcaacaccgcccgguuccguggaagccuucccacagagcaaugcugucauucaggaugaggaacgcgacaucccugagcgaucuuggaacucaggguaugaguggauaaccgauuuucccggaaaaacgguaugguucgugccauccauuaagaguggcaaugacaucgcgaacugucugaggaaaaauggcaagcggguuauccagcucagcaggaagacuuuugauacagaauaccagaaaaccaagaacaacgacugggacuacguggucaccacugauauuucggagaugggggccaauuuccgcgcagaccgugugaucgauccuagacggugccugaaacccguuauucuuaaggacggaccagaaagggugauacuagcugguccgaugccugucacaguggccucugcagcccagcgccgaggcagaaucgggcggaaccacaauaaagagggagaucaguauauuuacaugggccagccccugaacaaugacgaggaucaugcucacuggaccgaagccaagauguuguuagacaacaucaauacaccagaggguaucauucccgcgcuguucgaaccugagagggaaaaguccgcagccauagauggggaguaucgccucagaggcgaggcuaggaaaacuuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacgaaagagggagaaaggaagaaauugcggccccgcuggcuggacgcuagaaccuacucugacccucuagcacugagggaguucaaggaauuugccgcuggucggcgauccgugagcggcgaucucauucuugagaucgggaaacugccgcagcacuuaacacagagagcccaaaaugcauuggacaaccuggucaugcuccauaauucagaacagggaggccgcgcguauaggcacgccauggaggagcugccagauacuauugaaacccuuaugcugcucgcuuugaucgccguucugacagguggggugaccuuauucuuucuaaguggccggggacugggcaagacuagcauagggcuccuuuguguaauggcauccucugugcuguuguggauggcuagcgucgagccccauuggaucgccgcauccauuauccuggaguucuuucucauggugcugcuuauuccugagcccgaccgucagagaacgccacaggauaaccaacucgccuacguugugaucggacuguuguucaugauacugaccgucgcugcgaaugagauggguuuacuagaaacaacuaagaaagaccugggcauugggcacguagccgugggaaaccaccaucacgcagcuaugcucgauguugaccuucauccugccucagccuggacccuguacgcaguggcuacaaccaucauuacucccaugaugaggcacacaaucgagaacacgaccgccaauauaucuuugacugcgaucgcuaaccaggccgcaauucugaugggccucgauaaggguuggccaaucaguaaaauggacauuggggucccucugcuugccuuaggcugcuauucgcaagugaauccgcugacacucaccgcugcagucuugaugcugguggcccauuacgcgaucauaggacccggccuacaagcuaaggccacccgcgaagcacagaaacggacagccgcugggauuaugaagaacccaacuguugauggaaucguggccaucgaccuggauccuguaguguaugacgcaaaguuugagaaacagcucggccagauuaugcuucugaucuuguguacgagccaaauacugcucaugcgaaccacaugggcucugugcgaauccauuacuuuagccaccgguccccuuacaacccugugggaggggucuccaggaaaguucuggaauacuacgaucgcggucucaauggccaacauuuuuagaggcagcuaccucgcaggagcuggccuagccuucucccugaugaaaagucuagggggaggcaggcgcgggacaggagcacagggcgagacccugggugaaaaguggaaacggcagcucaaucagcuuucuaagagcgaguucaacacuuauaagagaucagggaucauggaaguugaccguuccgaggcuaaagaaggacugaagaggggcgagaccacaaaacacgccgugagucgggguacugccaaguugcgcugguuugucgagcgaaaucuggugaaaccugaaggcaagguaauagaucucggguguggaagaggcggguggagcuacuauugcgcgggauuaaagaaagugaccgagguuaagggcuacacaaaaggugggcccggacacgaagaaccgaucccaauggcuacguacggcuggaaccuggugaaacuucauucuggcaaagacgucuucuuuauuccucccgaaaagugugauacccugcuaugcgacaucggggaguccucaccaaaucccacuauugaggaaggaaggacacuccgggugcugaaaauggucgagccuugguugcgcgguaaccaauucuguaucaagauucugaauccguauaugcccagcgugguugaaacccucgagcagaugcagagaaagcacggcgggaugcuuguaaggaacccacugucgcgaaauucuacucaugagauguacugggugaguugcggaacaggcaacaucgucuccgcagugaauaugaccagccggauguuacugaaccguuuuacgauggcccacagaaaaccuaccuaugaacgcgauguugacuugggugcugggacaaggcacguggccgucgagcccgaaguggcaaaccucgauauaauuggacagcggaucgagaauaucaagcaugaacacaaaucaacuuggcauuacgacgaggauaacccuuauaagaccugggccuaccacggcuccuaugagguaaaaccaucuggcagcgcuaguuccauggugaaugggguugucaagcugcuaacaaagcccugggacgugauuccuauggugacucaaauagcgaugaccgauacaaccccauucggacagcagagagucuuuaaagaaaagguugacacucgcacgcccaaagccaagagggguacagcacaaaucauggaggugaccgcuaaauggcuuuggggcuuccugagccgaaacaagaagccgcggauuuguacuagagaagaguuuaccaggaaaguacgcucuaaugccgcaaucggggccguguucgucgacgaaaaccaguggaacucagcuaaggaggccguggaggaugaacguuuuugggaccucguucaucgggagagagaacugcacaaacagggaaagugcgcgacaugcguguacaacaugaugggcaaaagggagaagaaguugggugaguucgggaaagcaaagggaagucgcgccauuugguacauguggcugggcgcucgauuucucgaguucgaggcccuuggcuucaugaaugaagaucacugguuuucccgggagaacagccugucuggggucgaaggagaggguuuacauaaacugggcuauaucuugagagacauaucgaagaucccugggggaaauauguacgcagaugacacggcuggcugggauaccaggauuacugaggacgaucuccagaacgaagcccgcaucacagacauuauggagccagaacacgcucugcuagccaaaucaaucuucaaacuuaccuaucaaaauaaagugguaagaguucagcggcccgcaaagaacgguacugugauggaugucauaagcaggcgugaccagcgaggguccggacaggugggcacauacggccugaauaccuuuacaaacauggaggcgcaacucauucgccagauggaaagugaggggaucuucucuccuagcgagcuggaaacuccaaacuuggccgcuagaguguuagauuggcuggagaaguauggagucgaacggcucaaaaggauggccaucuccggugacgacuguguugugaagcccauugaugaccgcuuugcaaccgcucuuacggcccugaaugauaugggcaaaguaagaaaggacauaccgcagugggagccuucaaaaggguggaacgauuggcagcaagugcccuucugcagucaucacuuucaccagcuaaucaugaaggacggacgggaaauugucgugccauguaggaaucaggaugagcugguuggccgagcacgugugucucagggugccggguggagccucagagagaccgcgugcuugggaaaguccuacgcucaaauguggcagcugauguauuuccaucgccgggaccuuaggcuggccgcaaacgccaucuguucagcugucccuguggauuggauucccacaagcagaacuaccuggucuauccacgcccaucaccaguggaugacaacugaagacaugcucuccguauggaaucgcguuuggauagaggaaaacccauggauggaggauaaaacccauaucaguagcuggggcgacgugcccuacuuaggcaagcgggaagaccaauggugcgggucgcugauuggauugacggcaagggcuacaugggccaccaauauccaggucgcgauuaaccaggugcgaagacugaucgguaaugagaacuaccucgauuauaugacuuccaugaaacgguuuaagaaugagucugacccugaaggcgcucuuugguga

SEQ ID NO: 13289 - RNA, 9879 nt, Artificial Sequence
  derived and/or modified CDS sequence (opt3) from DENV-1__FJ850069__SS-prME
uccgugaccaugcugcucaugcuuaugcccacagcccuggcuuuccacuugacuacgcggggaggggaaccucauaugaucgucggaaagcaggaaagggguaaauccuuacuguuuaagaccucugcaggaguuaacaugugcacacugauugccauggaccucggggagcugugugaagauacuaugaccuacaaaugcccacggauaacagagguggaaccggacgauguagacuguuggugcaauaccacugauacaugggugaccuauggaacguguucacaaacuggcgagcaccgccgagacaagcguagugucgcgcuugcuccccaugugggucugggguuggagaccagagccgaaacauggaugagcuccgagggagcauggaaacagauccagaggguugaaacuugggcccuccggcacccuggcuucaccgugauugcucuguuucuggcacaugucaucggcacaucuauuacccagaaggggaucauauucauccucuuaaugcuggugacgccaucgauggccaugcgcugcguaggaauugguucaagagauuuuguugagggccuuagcggggcuacuuggguggacgucguguuggagcacggaaguugugugacaaccauggccaaggauaaacccacucuggacaucgaacuacucaagacagaggucaccaacccugcgguucugaggaaacuuugcauugaagcaaagaucuccaauacgaccacagauucucgguguccaacucaaggcgaggccacccugguggaagaacaagacgcuaacuucguaugccgccgaacauuuguggauagagguugggggaauggauguggcuuguucggcaaagggagccucauaacuugcgccaaguuuaagugcgucaccaaacuggagggaaagauugugcaguacgaaaacuuaaaauauuccguuaucgugacaguccacaccggugaccagcaucaagugggcaaugagucaacugaacacgggacgacagcaaccauuacuccccaggcuccuaccagugagauccagcugacagacuacggagcccucacccuugauuguagcccaaggacuggccuggacuucaacgaaaugguauugcuaacaaugaaggagaaaucuuggcugguucauaagcagugguuucucgaucugccgcuucccuggacguccggugcgucaaccagccaagagacuuggaaucggcaggaccuguuggugacauucaaaaccgcccacgcaaagaagcaggaagucgugguccucgggagucaagagggcgcuaugcacacagcccugacuggagcuaccgaaauccagacgucuggcaccacaacuauuuuugccgggcauuuaaaaugccgucugaagauggauaaacuaacccucaagggaauguccuaugugauguguacagguagcuucaaacuggagaaggaaguugcagagacucagcacggcaccgugcuuguacagauaaaguacgaggggacggacgccccuugcaaaaucccauucucgacacaagaugaaaagggagucacccagaacggccgcuugauuacugcuaaucccaucgugacagacaaagagaagccuguuaacauagaagcggagccacccuuuggugagucuuauauugugaucggggcaggcgaaaaagcccugaagcucuccugguucaagaaaggaucaaguaucggcaagauguuugaggcuaccgccagaggggcaaggcggauggccauucugggagauacugcuugggacuucgguagcaucggcggggucuuuaccuccgugggaaaacuuguacaucagauuuucggcacagccuacggugugcuguuuucugggguuagcuggacgaugaagauaggcaucggagucuugcucaccuggcugggcuuaaauucacgaaguacuucccugagcaugacauguauugcaguggggcuagugacccucuaccugggagucaugguucaggcggauucuggcugcgugaucaacuggaaaggucgcgaacuuaagugugggucaggaaucuucgugacaaaugagguacacacuuggaccgaacaauauaaguuucaggcugacaguccgaaaagauugagcgccgcaauuggcaaggccugggaggagggugucugcggcauaagguccgcuacgcggcuggaaaacaucauguggcgccagauuucuaacgagcucaaucauauccuguuagaaaacgacaugaaauucacagugguugugggggaugucgugggcauucuggcccagggcaagaaaaugaucagaccucaacccauggagcacaaguacucguggaaaagcugggggaaggcaaagauaaucggagcugacguucagaauaccacuuuuauuaucgauggcccaaacaccccugaaugucccgacgaucagagggccuggaauauuugggagguggaggacuaugguuucgggaucuuuacaacuaacauauggcuuaaauugcgugauuccuacacccagguaugcgaccaccggcucaugucagcggccauuaaggauaguaaagcuguccaugcagacaugggauauuggaucgaaucugagaagaaugaaacauggaaacuggcccgagcuagcuucauugaggugaagacguguaucuggccaaagucccacacccuauggucaaacggcgugcuggaaagcgagaugauaauccccaaaauuuacgguggcccuaucucucaacauaauuauagaccaggguacuucacucagacagccggaccguggcaccucggcaagcuggagcuugauuuugacuugugcgaagggaccacugucguuguggaugagcacugcggaaacaggggccccucccugcgcacaaccacgguaacugguaaaauuauccaugaaugguguugccggaguuguaccuuaccuccacucagauucaagggggaggacggaugcugguacggcauggagauaaggcccgugaaagaaaaggaggaaaaucuggucaagagcauggugucugcagguuccggcgagguugacucauuuagucuugggcuguuguguauuagcaucaugaucgaagaggugaugcgcucgcgauggucccggaaaaugcucaugacaggaacccuggcggucuucuuucuacugauuaugggccagcucacuuggaacgaucugauccgucuuugcauuauggugggggccaaugcuucugacagaaugggaaugggcacaaccuauuuggcccugauggcaacauucaagaugaggccuauguuugcuguugguuuacucuuccgccggcugacuagcagagaggugcuucugcuaaccauagggcucucacuggucgccaguguagaauugccaaacucccuggaggaauuaggagauggccucgcaaugggcaucaugauucugaaacuucugacggacuuucaaucuuaccaguugugggugacacuccugagccuaaccuucaucaagacuaccuuuucccugcacuaugccuggaaaacaauggcuaugguucuuucaauugugagccuccugcccuugugucugaguacuaccucucagaagacgacaugguuaccgguccuccuggggucccuuggaugcaagccucugaccauguucuuuaucgcggagaauaaaauaugggguagaaagagcuggccauugaacgaaggcaucauggccguggggauuguaucgauccuccugucaucucuacugaaaaacgaugugccccuugcaggaccucucauugcuggcgguaugcugaucgccuguuacgucauaaguggguccagcgccgacuugucuuuagagaaggcugcagagguuagcugggaagaggaagccgagcauuccggagcgucacacaauauucugguggaagugcaggaugacggcacuaugaaaaucaaggaugaggagcgagacgauacacucaccauccugcuuaaagcuacucuguuggccgucaguggcguguauccccuaagcauuccagcaacacuguucguuugguacuucuggcaaaagaagaaacagcgcucugggguacucugggacaccccuucacccccagaaguggagcgggccguccuggaugacggaauauauagaaucaugcagaggggucuuuuaggccguagccagguggggguuggaguguuucaagaaaacgucuuccauacgauguggcacgugacucgcggcgcuguacugauguaccaggguaagcggcucgagccgaguugggcaagcgucaaaaaggacuugauuuccuacgggggaggcuggagacugcagggcucuuggaauaccggggaggaagugcagguuaucgccguggagccuggcaagaaucccaagaauguccaaacagcgccagguaccuuuaagacacccgaaggcgaggugggggcuauugcccucgauuucaaaccuggaacuucgggcagcccaaucguuaacagggaagguaagauaguggggcuguauggaaauggcgucgugaccacgucaggcacauacguauccgcaaucgcccaggcuaaagccagucaggaggggccccuuccugagauugaagacgagguguuucgaaagcggaaccugacuaucauggauuugcacccgggaucugguaaaacccgcagauaucuaccagcaauuguuagggaagcuaucaagcggaagcugcgaacacucauauuagcccccaccagagucguggcgagcgagauggccgaagcacugaaaggcaugccuauucgcuaccaaacuaccgcugugaaguccgagcauacagggagggagaucgucgaccuuaugugccacgccacguucacuaugcgucugcucucaccaguacgggugcccaauuauaacaugaucauuauggaugaagcucauuuuaccgacccuucuagcaucgcagccagaggauacauaaguacaaggguuggcaugggugaggccgcugcgauuuucaugaccgcaacuccgcccggguccguggaagccuuuccacagagcaaugcugucauccaggaugaggaacgcgacauuccugagcgaucuuggaacucaggauaugaguggaucacagauuuccccggcaaaaccgugugguuuguuccauccauaaagaguggcaaugacauugccaacuguuugaggaaaaaugggaagcgggugauccagcugagcaggaagacguucgauacugaauaccagaaaacaaagaacaacgacugggacuacgucgugaccaccgauaucucggagaugggagcaaauuuccgcgccgaccguguaauugauccuagacggugccucaaacccgugauccugaaggacgguccagaaaggguuauucuugcuggcccgaugccugucacuguggcgucugccgcacagcgccgagggagaauaggacggaaccacaauaaagagggcgaucaguauaucuacaugggucagccccuaaacaaugacgaggaucaugcucacuggacagaagccaagaugcuguuggacaacauuaauaccccagaggggaucauccccgcauuauuugaaccugagagggaaaaguccgccgcuauugauggcgaguaucgccugagaggagaggccaggaaaacauucguggaacucaugcggcguggcgaccugccagucuggcuuagcuacaagguugcgucagagggguuucaauauagugaucgccgauggugcuucgacggagaaagaaacaaucaggugcuggaggaaaacauggauguagagauauggacuaaagagggugaaaggaagaaacuccggccccgcugguuggacgcaagaacguacucugacccucuggcccuaagggaguuuaaggaguucgcugccggccggcgauccaucagcggggaucugauucucgagaucggaaaacuuccgcagcaccugacccagagagcucaaaaugcauuagacaacuuggugaugcugcauaauucagaacagggcggucgcgccuauaggcacgcuauggaggagcucccagauacaauugaaacucugaugcuucuggcccucaucgcagucuugaccgggggcgugacacuguuuuucuuaaguggacggggccuagggaagaccagcauaggacugcucuguguuauggcguccucugcccuucuguggauggcuagcguggagccccauuggaucgccgcauccauuaucuuggaauuuuuccugaugguccuccugauuccugagcccgaccgucagagaacuccacaggauaaccaacuugcuuacguagugaucggucuccuguuuaugauauugacgguugccgcaaaugagaugggccuguuagaaaccacaaagaaagaccuagggauuggacacguggccgucgagaaccaccaucacgcuacuaugcuggauguggaccuccauccugcgucagccuggacccuuuacgcagucgcuacaaccaucauuacucccaugaugaggcacacaaucgaaaacacgaccgccaauauaucucugacugccaucgcaaaccaggcugccauuuugaugggccuggauaaggguuggccaaucaguaaaauggacauuggggugccucuccuggcgcuuggcugcuauucgcagguuaauccguuaacacugaccgcugccgugcucauguugguagcacauuacgccaucauaggacccggccugcaagcuaaggcaacccgcgaggcccagaaacggacagcggcugggauuaugaagaacccaacuguggauggaaucgucgccaucgaccuagauccuguuguguaugacgcaaaguucgaaaaacagcugggccagauuaugcuccuuauccuguguacgagccaaauauugcugaugcgaaccacaugggcccucugcgaguccauuacucuggcuaccggucccuuaacaacccuuugggaggggucuccaggaaaguuuuggaauacuacgaucgccgucucaauggcaaacauuuucagaggcagcuaccuggcuggugccggccucgcguucucccuaaugaaaagucuagggggaggcaggcgcgggacaggagcccagggcgaaaccuugggugagaaguggaaacggcagcugaaucagcucucuaagagcgaauuuaacacuuauaagagaucagggauccuugagguggaccguuccgaagcaaaagagggacugaggcggggcgagaccacaaagcacgcuguaagucgcgguacugccaaauugcgaugguucguggaaagaaaucugguuaagccugagggcaaagugauagaucucggguguggaaggggcggguggagcuacuauugcgcaggauuaaagaaggucaccgaagugaaaggcuacacaaagggugggcccggacacgaggaaccgaucccaauggcuacguacggcuggaaccuggucaaacuucauucuggcaaggacguguuuuucauuccucccgagaaaugugauacccugcuaugcgacaucggggaguccucaccaaaucccacuauugaagagggacggacacuccgcguucugaagaugguagaaccuugguugagagguaaccaauuuuguaucaaaauucugaauccguauaugcccagcguggucgagacccucgagcagaugcagaggaagcacggcgggaugcuugugcgaaacccacugucgagaaauucuacucaugaaauguacuggguuaguugcggaacaggcaacaucguguccgccgucaauaugaccagccguauguuacugaacagauucacgauggcccaccgcaagccuaccuaugagagggauguggacuugggugcggggacacggcacguagcuguggaacccgagguugcaaaccucgauauaauuggacagagaaucgaaaauaucaaacaugagcacaagucaacuuggcauuacgacgaggauaacccuuauaaaaccugggccuaccacggcuccuaugaagucaagccaucuggcagcgcuaguuccauggugaaugggguggucaaacugcuaacaaagcccugggacguuauuccuauggugacucaaauagccaugaccgauacaaccccauuuggacagcagcgcguauucaaggagaaaguggacacuaggacgcccaaggcaaaacgagguacagcccaaaucauggaagucaccgcuggcuggcuuuggggguuucugagccggaacaagaaaccgagaauuuguacuagggaggaguucacccgcaaggugcguucuaaugcggccaucggagcaguuuuuguggacgagaaccaguggaacucagcuaaggaggccgucgaagaugagcgguucugggaccucgugcauagagaaagggagcugcacaaacagggcaagugcgcaacaugcguauacaacaugauggguaaacgcgaaaagaaauugggggaguuuggaaaggccaagggcagucgagcuauuugguacauguggcugggcgcccgguuccucgaguucgaagcgcuuggguuuaugaaugaggaucacugguucuccagagaaaacagccugucuggaguugagggugagggcuuacauaaacugggguauaucuugagggacauaucgaagaucccuggaggcaauauguacgcagaugacacggccgguugggauacccgcauuacugaagacgaucuccagaacgaggcuaaaaucacagacauuauggaaccagagcacgcccugcuagcaaccucaaucuuuaaacuuacuuaucaaaauaaaguggucagagugcagcggcccgcuaagaacgggacagugauggaugucauaagcaggcgugaccagcgaggauccggccagguuggcaccuacgggcugaauacauucacuaacauggaagcccaacucauucgccagauggagagugagggaaucuuuucuccuagcgaacuggagaccccaaacuuggcugaaagaguguuagauuggcuggagaaauaugguguagaacggcucaagaggauggccaucuccggcgacgacuguguggucaagcccauugaugaccgcuucgcaacggcgcuuaccgcccugaaugauauggggaaagugagaaaggacauaccgcagugggagccuucaaaaggauggaacgauuggcagcaaguucccuuuugcagucaucacuuccaccagcuaaucaugaaggacggccgggagauuguggucccauguaggaaucaggaugaacuggugggucgagcucguguaucucagggggccggauggagccucagagagacagcaugcuugggcaaauccuacgcucaaauguggcagcugauguauuuucaucgccgggaccuuaggcuggccgcaaacgccaucuguucagcgguuccuguggauuggguccccacuagcagaaccacauggucuauucacgcucaucaccaguggaugacuaccgaagacaugcucuccguguggaaucgcguuuggaucgaggaaaacccauggauggaggauaagacgcauauaaguagcugggaggacgugcccuacuuaggcaagcgggaagaccaauggugcgggucgcugaucggauugacagccagggcaaccugggccacuaauauucaggucgcuaucaaccaggugcgaagacugauugguaaugagaacuaccucgauuauaugacauccaugaaacgguucaagaaugaaucugacaccgagggcgcccuuugguga

SEQ ID NO: 13290 - RNA, 9879 nt, Artificial Sequence
  derived and/or modified CDS sequence (opt3) from DENV-1__FJ639680__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuugcccagggcaaaaagaugauccgcccucaacccauggaguacaaauauucguggaaaagcuggggcaaggcgaaaauaaucggggccgacgcucagaauacuaccuucauuaucgauggaccaaacacaccugaaugucccgacgaucagagagcauggaauauuugggagguggaggacuacggcuuugguaucuucacuaccaacauaugguugaagcucagggauuccuauacacaggucugcgaccaccgucugaugucagccgcuauuaaagauaguaaggccgugcacgcagacaugggguacuggaucgaaucugagaaaaaugaaacguggaagcuagcgcgggccagcuuuauugagguuaagaccuguaucuggccaaaaucccauacucuguggucaaacggagugcucgaaagcgagaugauaauccccaagauuuauggcgguccuaucucucaacacaauuaccgaccaggcuacuucacacagaccgcugggccguggcaucugggaaaacuugaguuggauuucgaccugugcgaaggcacuacaguagucguggaugagcacugcgggaacagaggacccuccuuaaggaccacgacugugaccggcaagauuauccacgaaugguguugccgcaguuguacacucccuccacugcgguuuagaggugaggacgggugcugguauggaauggagauaaggcccgucaaagaaaaggaggaaaaucuuguuaagagcauggugucugccggcuccggugagguagacucauucagucugggcuugcucuguauuagcaucaugaucgaagaggugaugcgcucgcgauggucccggaaaaugcugaugaccgggacucuagcagucuuuuuccugcucauuaugggacagcugacauggaacgaucuuauccguuugugcauuauggugggcgcuaaugccucugacagaauggggaugggaaccacauaccuggcauuaauggccacuuuuaagaugaggccuauguucgcuguuggccuccuguuucgccggcuuaccagcagagaggugcugcuacucacgauaggucugucauuggucgcgaguguggaacugccaaacuccuuagaggaacucggggauggacuggccaugggcaucaugauucuuaaacuguugacagacuuccaaucucaucagcucugggcaacccugcuaagccugacuuuuaucaagaccacauucucccuucacuaugcuuggaaaacuauggccaugguucucucaauugugagccuguuucccuugugucugaguaccacgucucagaagacaaccugguuaccgguccuccugggcucccuugggugcaagccucugacuauguucuugaucgccgagaauaaaauauggggaagaaaguccuggccacucaacgaagguaucauggcuguaggcauugugucgauccugcuaucaucucugcuuaaaaacgauguuccccucgcagggccucugauugccggaggcauguugaucgcguguuacgugauaagugguuccagcgcugacuuaucucuggagaaggccgcagaggucagcugggaagaggaagccgagcauuccggggcuucacacaauauucucguggaaguacaggaugacggaacaaugaaaaucaaggaugaggagcgagacgauacccugacuauccuucugaaagcaacauugcuagccgugaguggcgucuauccccugagcauuccagcgacccucuuuguuugguacuucuggcaaaagaagaaacagcgcucuggcgugcugugggacacgccuucacccccagaaguggagcgggcuguccuugaugacgggauauauagaaucaugcagaggggauuacugggucguagccaggugggcguugggguauuccaagaaaacguguuucauacuauguggcacgucacccgcggagccgugcucauguaccagggcaagcgguuggagccgaguugggcaagcguuaaaaaggaccugauuuccuacggugggggauggagacuccagggcucuuggaauacaggcgaggaagugcaggucaucgccguggagccugggaaaaaccccaagaauguacaaaccgcuccaggaacauucaagacucccgaaggugaggucggcgccauugcacuggauuuuaaaccugggaccucgggaagcccaaucgugaacagggaaggcaagauaguuggucuuuaugggaauggaguggucacgacaucaggcacuuacguguccgcuaucgcccaggcgaaagccagucaggagggcccccugccugagauugaagacgagguuuuccgaaagcggaacuugaccaucauggaucuacacccggggucuggaaaaacacgcagauaucugccagcaauugugagggaagcuaucaagcggaagcuccgaaccuuaauacuggcccccacuagagucguggcuagcgagauggcagaagcccuuaaagguaugccuauucgcuaccaaaccacagccguaaaguccgagcauacgggcaaagagaucguggaccugaugugccacgcuacuuuuaccaugaggcucuugucaccaguucguguccccaauuauaacaugaucauuauggaugaagcgcauuucacagacccuucuagcaucgcagcccggggguacauaaguaccagagugggaaugggcgaggcugccgcaauuuuuaugacugccacaccgcccgguuccguggaggcuuucccacagagcaaugcggucauccaggaugaggaaagggacauuccugagcgcucuuggaacucaggguaugaguggaucaccgauuuucccggaaagacgguaugguucgugccauccauaaaaaguggcaaugacauugccaacugucugcgaaagaauggcaagagaguuauccagcucagccggaaaacuuuugauacagaauaccaaaagaccaaaaacaacgacugggacuacguggucaccacugauaucucggagaugggggcaaauuucagggcugaccgcgugauugauccucguagaugccugaagcccguuauccuuaaagacggaccagaacgggugauucuagccgguccgaugccugucacaguggcaucugccgcucagaggcgcggccgaauagggagaaaccacaauaaggagggagaucaguauaucuacaugggccagccccugaacaaugacgaggaucaugcccacuggaccgaagcgaagauguuguuagacaacauuaauacaccagaggguaucauccccgcacuguucgaaccugagcgggaaaaauccgccgcuauugauggggaguauaggcuccgcggcgaggccagaaagacuuuuguagaacugaugaggcggggagaccuuccaguguggcugagcuacaaaguugcuucagagggcuuccaauauagugaucgucgcuggugcuuugacggggaacgaaacaaucagguccucgaggaaaacauggauguggagauauggacgaaggagggagaaaggaaaaaguugaggccccgguggcuggacgcacgcaccuacucugacccucuagcccugagagaguucaaagaauuugcugccgguaggcgguccgugagcggcgaucucauccuugagauugggaagcugccgcagcacuuaacacagcgagcacaaaaugcguuggacaaccuggucaugcuccauaauucagaacagggaggcagagccuaucgccacgcuauggaggagcugccagauacuaucgaaacccuuaugcugcucgccuugauugcaguucugacagguggggugaccuuauucuuucuaaguggcaggggacugggcaagacuagcaucgggcuccuuuguguaauggcuuccucugugcuguuguggauggccagcgucgagccccauuggauagcagccuccaucauucuggaguucuuucucauggugcugcuuaucccugagcccgaccggcagcguacgccacaggauaaccaacucgcuuacguugugauuggacuguuguucaugauccugaccgucgcggccaaugagauggguuuacuagaaacaacuaaaaaggaccugggcauagggcacguagcaguggagaaccacaaccaugcugccaugcucgauguugaccuucacccugccucagcauggacccuguacgcuguggccacaaccauuaucacucccaugaugagacauacaauugaaaauacgaccgcgaacaucucuuugacugcuauagccaaucaggcagccauccugaugggacucgauaaaggcuggccaauuaguaagauggacaucggugucccucugcuugcuuuagggugcuauagccaggugaacccgcugacacucaccgcagccgucuugaugcugguggcgcacuacgcuauuaucggccccggacuacaagccaaagcaaccagggaggcccagaagcgcacagcugccggcauaaugaagaauccaacuguugaugggauuguggcaaucgaccuggauccuguaguguaugacgcuaaauuugaaaagcagcucggacagaucaugcuucugauuuuguguacgagccaaauccugcucaugcggaccacaugggcccugugcgaguccauaacuuuagcgaccggcccccuuacaacccugugggaggguucuccagggaaauucuggaacacuacgauugccgucucaauggcaaauaucuuucgaggaagcuaccucgcuggcgccggucuagcauucucccugaugaagaguuugggcgggggaagaaggggcacaggggcucagggagaaacccugggcgagaaauggaagcgccagcucaaccagcuuucuaagagcgaguucaauacuuauaaacggucagguauuauggagguugacagauccgaagccaaggaggggcugaaacguggagagaccacaaagcaugccgugaguaggggcacugcgaaauugcggugguuugucgaacgcaaccuggugaagccugaggguaagguaaucgaucucggcugugggcgaggaggcuggagcuacuauugcgcugggcuaaagaaggugaccgaaguuaaaggauacacaaagggcggucccgggcacgaggaaccgauaccaauggcaacguacggauggaaucuggugaaacuucacucuggcaaggacgucuucuuuaucccucccgagaaaugugauacccugcuaugcgacauuggcgaguccucaccaaaccccacuaucgaagaggggagaacacucagggugcugaagauggucgaaccuugguugcggggaaaucaauucuguauuaagauccugaacccguauaugcccagcgugguugagacccucgagcagaugcagcgcaaacaugguggcaugcuuguaagaaauccacugucgaggaacucuacucacgaaauguacugggugaguugcgggacaggaaauauugucuccgccgugaacaugaccagccgaauguuacugaaccgguuuacgauggcucaucguaagccuaccuaugagagagauguugacuugggcacagguacucgccacguggccgucgaacccgagguggcaaaucucgauaucauagggcagaggauugaaaacaucaaacacgagcauaagucaaccuggcacuacgacgaggauaauccuuauaaaacaugggccuaccauggauccuaugaaguaaagccaucuggcagcgcuaguuccauggugaacggcguugucaagcugcuaacuaaacccugggacgugaucccuauggugacccaaauugcgaugacagauaccacuccauucgggcagcagcgggucuuuaaggagaaaguugacacgagaacacccaaggccaaacgcggaaccgcacaaauaauggaagugacugcuagguggcuuugggguuuccugagccgaaauaagaagccgcggaucuguaccagagaggaauuuacaaggaaaguacgcucuaacgccgcaauuggcgccguguucgucgacgagaaucaguggaacucagcuaaggaggccguggaagaugagcguuuuugggaccucguucaccgggaaagagagcugcauaaacaggggaagugcgcgacgugcguguacaauaugaugggaaaaagggaaaagaaguugggcgaguucgguaaagcaaaggggagucgcgccaucugguacauguggcugggagcucgauuucucgaguucgaagcccuuggcuucaugaacgaggaucacugguuuucccgggaaaauagccugucuggcgucgagggggagggauuacacaaacuggguuauauuuugagagacaucucgaagauaccuggcgggaacauguacgcagaugacaccgcuggaugggauacuaggaucacagaagacgaucuccagaaugaggccaaaauuaccgacaucauggaaccagagcaugcucugcuagccaaggcaauuuucaaacuuacuuaucaaaacaaggugguacgcguucagagacccgcgaagaauggcacagugauggaugucaucucacggagggaccagcgugguagcggacaggugggaaccuacggccugaacacauuuacuaacauggaagcccaacucauacgacagauggaguccgagggcauuuucaguccuucugaacuggagaccccaaauuuggcugaacgcgccuuagauuggcuggagaaauaugggguggaaagacucaagcggauggcaaucagcggagacgacugugucguuaaacccaucgaugacagguuugcuacggcccuuaccgcacugaacgauauggguaaggugcgcaaagacauuccgcagugggagccuuccaagggcuggaaugauuggcagcaaguacccuucugcucacaccauuuucaccagcuaauaaugaaggacgggagagagaucguggucccaugucggaaccaggaugaacuggugggaagggcccgaguuagucagggcgcggguuggucucuccgugagacagcuugcuuggggaaaagcuacgcccaaauguggcagcugauguauuuccacagacgcgaccuucggcuggcagccaaugcuauuuguuccgccgugccugucgauugggugcccacuucaaggaccacauggagcauccaugcacaccaucaguggaugacuaccgaagacaugcucucuguauggaacagaguuuggauugaggaaaauccauggauggaggauaagacgcacaucuccaguugggaggacgugcccuacuuaggaaaacgcgaagaccaauggugcggcagccugauaggcuugacagcucgggccaccugggcgacuaacauccaggucgcuauuaaucaggugaggcgacugaucgggaacgagaauuaccucgauuauaugacaucgaugaagagauuuaaaaacgaauccgacccugagggagcccuuugguga

SEQ ID NO: 13291 - RNA, 9879 nt, Artificial Sequence
  derived and/or modified CDS sequence (opt3) from DENV-1__FJ639682__SS-prME
agcgugaccaugcugcucaugcuuaugcccacagcccuggcuuuccacuugacuacgaggggaggggaaccucauaugaucgucuccaagcaggaaaggggaaaaucuuuacuguuuaagaccucagcggguguuaauaugugcacacuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcuccccaugucggccuggguuuggagacuagaaccgaaacauggauguccucugagggggccuggaaacagauccagaggguggaaacuugggcccuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggagaaaacucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaagcugacuguagucgugggcgauguugcagggauucuugcucagggcaaaaagaugauccgcccucaacccauggaguacaaauauucguggaaaagcuggggcaaggccaagauaaucggggcggacgcccagaauaccacauucauuaucgauggaccaaacacuccugaaugucccgacgaucagagagcuuggaauauuugggagguggaggacuacggcuuugguaucuucaccacaaacauaugguugaagcucagggauuccuauacgcaggucugcgaccaccgucugaugucagcagccauuaaagauaguaaggcugugcacgccgacaugggguacuggaucgaaucugagaaaaaugaaaccuggaagcuagcacgggcgagcuuuauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugccgggccguggcaucugggaaaacuugaguuggauuucgaccugugcgaaggcacaaccguagucguggaugagcacugcgggaacagaggacccuccuuaaggacgacuaccgugacaggcaagauuauccacgaaugguguugccgcaguuguacccucccuccacugcgguuuagaggugaggacgggugcugguauggaauggagauaaggcccgucaaagaaaaggaggaaaaucuuguuaagagcauggugucugcuggcuccggugagguagacucauucagucugggcuugcucuguauuagcaucaugaucgaagaggugaugcgcucgcgauggucccggaaaaugcugaugacugggacacuagccgucuuuuuccugcucauuaugggacagcugaccuggaacgaucuuauccguuugugcauuauggugggcgcaaaugcuucugacagaauggggaugggaacaacuuaccuggccuuaauggcaaccuuuaagaugaggccuauguucgccguuggccuccuguuucgccggcuuacgagcagagaggugcugcuacucacaauaggucugucauuggucgcuaguguggaacugccaaacuccuuagaggaacucggggauggacuggcgaugggcaucaugauucuuaaacuguugaccgacuuccaaucucaucagcucugggccacucugcuaagccugaccuuuaucaagacaacuuucucccuucacuaugcauggaaaaccauggcuaugguucucucaauugugagccuguuucccuugugucugaguacgacaucucagaagaccacuugguuaccgguccuccugggcucccuugggugcaagccucugacaauguucuugaucgccgagaauaaaauauggggaagaaaguccuggccacucaacgaagguaucauggccguaggcauugugucgauccugcuaucaucucugcuuaaaaacgauguuccccucgcugggccucugauugcaggaggcauguugaucgccuguuacguguuaagugguuccagcgcggaccugucucucgagaaggcugccgaggucagcugggaagaggaagcagagcauuccggggccucacacaauauacugguggaaguacaggaugacggaaccaugaaaauuaaggaugaggagcgagacgauacucuuacaauccuguugaaagcuacccuacuggcagugaguggcgucuauccccucagcaucccagccacgcuguuuguuugguacuucuggcaaaagaagaaacagcgcucuggcgugcuuugggacacuccuucacccccagaaguggagcgggcggucuuagaugacgggauuuauagaauaaugcagaggggacugcucggucguagccaggugggcguugggguauuccaagaaaacguguuucauaccauguggcacgucacacgcggagcuguguugauguaccagggcaagcggcuggagccgaguugggccagcguuaaaaaggaccucaucuccuacggugggggauggagacugcagggcucuuggaauaccggcgaggaagugcaggucauugcaguggagccugggaaaaaccccaagaauguacaaacagccccaggaacuuucaagacccccgaaggugaggucggcgcuaucgcccuugauuuuaaaccugggacgucgggaagcccaauugugaacagggaaggcaagaucguuggucuguaugggaauggaguggucacaacuucaggcaccuacguguccgcaauagcucaggccaaagcgagucaggagggccccuugccugagaucgaagacgagguuuuccgaaagcggaaccuaacaauuauggaucugcacccggggucuggaaaaacccgcagauaucucccagccaucgugagggaagcaauuaagcggaaguuacgaacucugauccuugcucccaccagagucguggccagcgagauggcugaagcacugaaagguauaccuauucgcuaccaaacaacggccguaaaguccgagcauacuggcaaagagaucguggaccucaugugccacgccaccuuuacaaugagguugcugucaccaguucguguccccaauuauaacaugaucauuauggaugaagcucauuucaccgacccuucuagcaucgcggcacggggguacauaaguacuagagugggaaugggcgaggccgcugccauuuuuaugacagcaaccccgcccgguuccguggaagccuucccacagagcaaugcugucauccaggaugaggaaagggacauuccugagcgcucuuggaacucaggguaugaguggaucacggauuuucccggaaagacuguaugguucgugccauccauaaaaaguggcaaugacauugcgaacugucuccgaaagaauggcaagagaguuauccagcugagccggaaaacauuugauaccgaauaccaaaagaccaaaaacaacgacugggacuacguggucacuacagauaucucggagaugggggccaauuucagggcagaccgcgugauugauccucguagaugccuuaagcccguuauccuaaaagacggaccagaacgggugauucuggcugguccgaugccugucaccguggccucugcagcccagaggcgcggccgaauagggagaaaccacaauaaggagggagaucaguauaucuacaugggccagcccuugaacaaugacgaggaucaugcucacuggacagaagccaagauguuacuggacaacauuaauacuccagaggguaucauccccgcacucuucgaaccugagcgggaaaaauccgcagccauugauggggaguauaggcugcgcggcgaggcuagaaagacguuuguagaacuuaugaggcggggagaccugccaguguggcucagcuacaaaguugccucagagggcuuccaauauagugaucgucgcuggugcuuugacggggaacgaaacaaucaggucuuggaggaaaacauggauguggagauauggaccaaggagggagaaaggaaaaagcugaggccccgguggcuagacgcucgcacauacucugacccucuggcacucagagaguucaaagaauuugccgcugguaggcgguccgugagcggcgaucuuauccuggagauugggaaguuaccgcagcacuugacucagcgagcccaaaaugcacuggacaaccucgucaugcugcauaauucagaacagggaggcagagcguaucgccacgccauggaggagcuuccagauaccaucgaaacacugaugcucuuggcucugauugccguuuuaaccgguggggugacucuauucuuucugaguggcaggggacucggcaagacgagcaucgggcuucuguguguaauggcauccucuguguugcuguggauggcuagcgucgagccccauuggauagccgcauccaucauucucgaguucuuucugauggugcuucucaucccugagcccgaccggcagcguaccccacaggauaaccaacuggccuacguugugauuggauugcuguucaugaucuuaacagucgcugcgaaugagaugggucuacuggaaacuaccaaaaaggaccucggcauagggcacguagccguggagaaccaccaucacgcagcuaugcuugauguugaccugcauccugccucagccuggacauuguacgcaguggcuaccacuauuaucacacccaugaugagacacacgauugaaaacaccacugccaauaucucucugacagcgauagcuaaccaggccgcaauccucaugggacuggauaaaggcuggccaauuaguaagauggacaucggugucccucuuuuagcccuggggugcuauagccaggugaauccgcucaccuugaccgcugcaguccugaugcuaguggcccauuacgcgauuaucggccccggacugcaagcuaaagccacaagggaggcacagaagcgcacugccgcuggcauaaugaagaacccaacgguugaugggauuguggccaucgaccucgauccuguaguguaugacgcaaaauuugaaaagcagcuuggacagaucaugcuguugauucuguguaccagccaaauccuccugaugcggacaacuugggcuuuaugcgaguccauaacccuugccacaggcccccugaccacucucugggaggguucuccagggaaauucuggaauacgacaauugcggucucaauggccaacaucuuucgaggaagcuaccuagcaggcgcuggucuggccuucuccuugaugaagagucugggcgggggaagaaggggcaccggggcacagggagaaacucucggcgagaaauggaagcgccagcuuaaucagcugucuaagagcgaguucaacaccuauaaacggucagguauuauggagguugacagauccgaagcuaaggagggguugaaacguggagagacaacuaagcacgccgugaguaggggcaccgccaaacugcggugguuugucgaacgcaaucucgugaagccugaggguaagguaaucgauuuaggcugugggcgaggaggcuggagcuacuauugcgcggggcugaaaaaggugacagaaguuaaaggauacacgaagggcggucccgggcacgaggaaccgauaccaauggcuaccuacggauggaaccuugugaaacugcauucuggcaaggacgucuucuuuaucccucccgagaaaugugauacucuacucugcgacauuggcgaguccucaccaaaucccacaaucgaagaggggagaacccugaggguguugaagauggucgaaccuuggcugcggggaaaccaauucuguauuaagauccucaauccguauaugcccagcgugguugagacucuugagcagaugcagcgcaaacacgguggcaugcugguaagaaacccauuaucgagaaauucuacacaugaaauguacugggugaguugcgggaccggaaacauugucuccgcagugaauaugacgagccgaaugcuguugaaccgguuuaccauggcccaccguaagccuacauaugagagagauguugaccucggcacugguacccgccacguggcugucgaacccgagguggccaaccuggauaucauagggcagaggauugaaaauaucaaacaugagcacaagucaacauggcauuacgacgaggauaacccuuauaaaacuugggcauaccacggauccuaugaaguaaagccaucuggcagcgccaguuccauggugaauggcguugucaagcuacuuaccaaacccugggacgugaucccuauggugacacaaauugcuaugaccgauacuacgccauucgggcagcagcgggucuuuaaggagaaaguugacacaagaacccccaaggcgaaacgcggaacugcccaaauaauggaagugaccgcaagguggcugugggguuuccucagccgaaacaagaagccgcggaucuguacaagagaggaauuuacgaggaaaguacgcucuaaugcugccauuggcgcaguguucgucgacgagaaccaguggaacucagccaaggaggcuguggaagaugagcguuuuugggaccugguucaucgggaaagagaguugcacaaacaggggaagugcgcaaccugcguguacaacaugaugggaaaaagggaaaagaagcugggcgaguucgguaaagcgaaggggagucgcgcaaucugguacauguggcucggagcccgauuucuugaguucgaagcucugggcuucaugaaugaggaucacugguuuucccgggaaaacagcuuaucuggcgucgagggggagggacugcauaaauuggguuauauucucagagacaucucgaagauaccuggcgggaauauguacgccgaugacacugcaggaugggauacaaggaucaccgaagacgaucugcagaacgaggcuaaaauuacugacaucauggaaccagagcacgcccuacuugcuaaggccauuuucaaacugacauaucaaaauaaggugguacgcguucagagacccgcaaagaacggcaccgugauggaugucaucucacggagggaccagcgugguagcggacaggugggaacauacggccucaauacuuuuaccaacauggaagcgcaacugauacgacagauggaguccgagggcauuuucaguccuucugaauuggagacgccaaacuuagccgaacgcgcucuggauuggcucgagaaauaugggguggaaagacuuaagcggauggccaucagcggagacgacugugucguuaaacccaucgaugacagguuugcaaccgcucugacagcccuaaaugauauggguaaggugcgcaaagacauuccgcagugggagccuuccaagggcuggaacgauuggcagcaaguacccuucugcucacaucacuuucaccagcugauaaugaaggacgggagagagaucguggucccaugucggaaucaggaugaacucgugggaagggcacgaguuagucagggcgccgguuggucuuugcgugagacugcgugccuggggaaaagcuacgcucaaauguggcagcuuauguauuuccauagacgcgaccugcggcucgccgcaaacgccauuuguuccgcugugccugucgauugggugcccaccucaaggacaacuuggagcauccacgcccaucaccaguggaugaccacggaagacauguuaucuguauggaauagaguuuggauugaggaaaacccauggauggaggauaagacacauaucuccaguugggaggacgugcccuaccugggaaaacgcgaagaccaauggugcggcagcuugauaggccugaccgcacgggcuacuugggccacaaauauccaggucgcgauuaaccaggugaggcgacucaucgggaaugagaacuaccuugauuauaugaccucgaugaagagauuuaaaaaugaauccgacccugagggagcucugugguga

SEQ ID NO: 13292 - RNA, 9879 nt, Artificial Sequence
  derived and/or modified CDS sequence (opt3) from DENV-1__JQ287664__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaggguugaaacuugggcccuccggcacccuggauucaccgugauugcucuguuucuggcacaugucaucggcacaucgauuacccagaagggcaucauauucauccucuuaaugcuggugacgccaucaauggccaugcgcugcguagggauuggaagcagagauuuuguugagggucuuaguggcgcuacuuggguggacgucguguuggagcacggguccugugugacaaccauggccaaggauaaacccacucuggacaucgaacuacucaagacagaggucaccaacccugcgguucugaggaaacuuugcauugaagcaaagaucucuaauacgaccacagauagccgguguccaacucaaggagaggccacccugguggaagagcaggacgcuaacuucguaugccgccgaacauuuguggauagaggcugggguaauggguguggauuguucggcaaaggcucccucauaacuugcgccaaguuuaagugcgucaccaaacuggaggggaagauugugcaguacgaaaacuuaaaauauucaguuaucgugacaguccacaccggagaccagcaucaaguggguaaugagaguacugaacacggcacgacagcaaccauuacuccccaggcuccuaccagcgagauccagcugacagacuacggggcccucacccuugauuguucuccaaggacuggacuggacuucaacgaaaugguauugcuaacaaugaaggagaaauccuggcugguucauaagcagugguuucucgaucugccgcuucccuggacgucaggcgcgagcaccagucaagagacuuggaaucggcaggaccuguuggugacauucaaaaccgcccacgcaaagaagcaggaagucgugguccucgguucucaagagggggcuaugcacacagcccugacuggcgcuaccgaaauccagacguccggaaccacaacuauuuuugccggccauuuaaaaugccgucugaagauggauaaacuaacccucaaggggaugagcuaugugauguguacaggaucguucaaacuggagaaggaaguugcagagacucagcacgguaccgugcuuguacagauaaaguacgagggcacggacgccccuugcaaaaucccauucucuacacaagaugaaaagggggucacccagaacggacgcuugauuacugcuaaucccaucgugacagacaaagagaagccuguuaacauagaagcggagccacccuuuggcgaguccuauauugugaucggugcaggggaaaaagcccugaagcucucaugguucaagaaaggcaguagcaucggaaagauguuugaggcuaccgccagaggcgcaaggcggauggccauucugggggauacugcuugggacuucggauccaucgguggcgucuuuaccucuguggggaaacuuguacaucagauuuucggaacagccuacggcgugcuguuuagcgguguuucauggacgaugaagauagggaucggcgucuugcucaccuggcugggauuaaauagucgauccacuagccugucuaugacauguauugcagugggccuagugacccucuaccugggggucaugguucaggcggauucaggaugcgugaucaacuggaaaggccgcgaacuuaagugugguagugggaucuucgugacaaaugagguacacacuuggaccgaacaauauaaguuucaggcugacagcccgaaaagauuguccgccgcaauuggaaaggccugggaggagggcgucugcgguauaaggucugcuacgcggcuggaaaacaucauguggcgccagauuucgaacgagcucaaucauauccuguuagaaaacgacaugaaauucacagugguugugggcgaugucguggggauucuggcccagggaaagaaaaugaucagaccucaacccauggagcacaaguacagcuggaaauccuggggcaaggcaaagauaaucggggcugacguucagaauaccacuuuuauuaucgauggaccaaacaccccugaaugucccgacgaucagagggccuggaauauuugggagguggaggacuauggcuucgguaucuuuacaacuaacauauggcuuaaauugcgugauucauacacccagguaugcgaccaccggcucaugagugcggccauuaaggauucuaaagcuguccaugcagacaugggguauuggaucgaaagcgagaagaaugaaacauggaaacuggcccgagcuuccuucauugaggugaagacguguaucuggccaaagucacacacccuauggagcaacggagugcuggaaucugagaugauaauccccaaaauuuacggcgguccuaucucccaacauaauuauagaccaggcuacuucacucagacagccgggccguggcaccucggaaagcuggagcuugauuuugacuugugcgaaggcaccacugucguuguggaugagcacugcgggaacaggggacccagucugcgcacaaccacgguaacuggcaaaauuauccaugaaugguguugccggagcuguaccuuaccuccacucagauucaagggugaggacgggugcugguacggaauggagauaaggcccgugaaagaaaaggaggaaaaucuggucaagucuaugguguccgcaggcucaggugagguugacaguuuuagccuuggccuguuguguauuucgaucaugaucgaagaggugaugcgcucccgauggucucggaaaaugcucaugacagggacccuggcggucuucuuucuacugauuaugggacagcucacuuggaacgaucugauccgucuuugcauuauggugggcgccaaugcuagcgacagaauggggaugggaacaaccuauuuggcccugauggcaacauucaagaugaggccuauguuugcuguuggcuuacucuuccgccggcugacuucaagagaggugcuucugcuaaccauaggucucagucuggucgccuccguagaauugccaaacucucuggaggaauuaggggauggacucgcaaugggcaucaugauucugaaacuucugacggacuuucaaagcuaccaguugugggccacacuccugucccuaaccuucaucaagacuaccuuuucacugcacuaugcuuggaaaacaauggcgauggugcuuagcauuguuagucuccugcccuugugucugucuacuaccucccagaagacgacaugguuaccggugcuccugggcagccuugggugcaagccucugaccauguucuuuaucgccgagaauaaaauauggggaaggaagucguggccauugaacgaagguaucauggcagucggcauugugucaauccuccugucuagucuacugaaaaacgauguaccccuugcugggccucucauugccggaggcaugcugaucgccuguuacgugauauccgguagcucugcugacuugagcuuagagaaggcagccgaggucuccugggaagaggaagcggagcauucaggggcuagucacaauauucugguugaagugcaggaugacggaacuaugaaaaucaaggaugaggagcgagacgauacacucaccauccugcuuaaagccacucuguuggcagugagcggcgucuauccccuaucuauuccagccacacuguucgugugguacuucuggcaaaagaagaaacagcgcuccggcguucucugggacaccccuucacccccagaaguagagcgggcugugcuggaugacgggauauauagaaucaugcagaggggacuuuuaggucguagucaggucggcguggggguuuuucaagaaaacguguuccauacgauguggcacgucacucgcggagcagugcugauguaccagggcaagcggcucgagccgagcugggccuccguaaaaaaggacuugauuucuuacggugggggauggagacugcagggcucguggaauaccggcgaggaaguccaggugaucgcgguugagccugggaaaaaccccaagaaugugcaaacagcuccaggaaccuuuaagacacccgaaggugaggucggcgccauugcacucgauuucaaaccugggacuagcggaucaccaaucgugaacagggaaggcaagauaguuggucuguaugggaauggaguggucaccacguccggcacauacgugagugccaucgcucaggccaaagcaucucaggagggcccccuuccugagauugaagacgagguauuucgaaagcggaaccugacuaucauggauuugcacccggggagcggaaaaacccgcaaguaucuaccagcuauugugagagaagccaucaagaggaaacugcggacacucauauuagcgcccacccgaguugucgccuccgagauggcagaagcucugaaggguaugccuauuagauaccaaacuaccgccgugaaaucagagcauacaggccgcgagaucguggaccuuaugugccacgcuacguucacuaugaggcugcucucuccaguccguguacccaauuauaacaugaucauuauggaugaagcacauuuuaccgacccuagcaguaucgccgcccggggguacauauccacaagagugggaaugggcgaggcugcggcaauuuucaugaccgccacuccgcccgguagcguugaagcuuuuccacagucuaaugccgugauccaggaugaggaaagggacauuccugagcgcucauggaacuccggguaugaguggaucacagauuuccccggaaagaccgucugguuugugccaaguauaaaaagcggcaaugacauugcaaacuguuugcgaaagaauggcaagagaguuauccagcugucgcggaaaacguucgauacugaauaccaaaagacaaaaaacaacgacugggacuacguggucaccaccgauaucucugagaugggggccaauuucagggcugaccgcgugauugauccucguagaugccucaagcccguaauccugaaagacggaccagaacgggugauucuugcggguccgaugccuguuacugucgccuccgcagcucagaggcgcggccgaauagggagaaaccacaauaaggagggagaucaguauaucuacaugggccagccccuaaacaaugacgaggaucaugcccacuggacagaagcaaagaugcuguuggacaacauuaauaccccagaggguaucauccccgccuuauuugaaccugagcgggaaaaaagcgcugccauugauggggaguauaggcugcgcggcgaggcgagaaagacauucguggaacucaugaggcggggagaccugccaguguggcuuucauacaaagucgcaagugagggcuuucaauauucugaucgucgcuggugcuucgacggggaacgaaacaaucagguucuggaggaaaacauggauguggagauauggacuaaggagggagaaagaaaaaagcucaggccccggugguuggacgcccgcacguacuccgacccucuggcucuaagagaguuuaaagaauucgccgcugguaggcggagcaucucaggcgaucugauucucgagaucgggaagcuuccgcagcaccugacccagcgagcacaaaaugccuuagacaacuugguaaugcugcauaauagugaacagggaggcagagcuuaucgccacgccauggaggagcucccagauacaauugaaacucugaugcuucuggcacucaucgcgguguugaccgguggggucacacuguuuuucuuaagcggcaggggacuaggcaagaccuccauagggcugcucugugugauggccucuagcgcucuucuguggauggccuccguugagccccauuggaucgcagcuucaauuaucuuggaauuuuuccugauggugcuccugauuccugagcccgaccggcagcguacuccacaggauaaccaacuugccuacgucguaaucggacuccuguuuaugauauugacgguggcagccaaugagaugggucuguuagaaaccacaaaaaaggaccuaggcauugggcacguugcuguggagaaccaccaucacgcgacuaugcuggaugucgaccuccauccugccucugcauggacccuuuacgcuguggccacaaccaucauuacucccaugaugagacacacaaucgaaaacacgaccgccaauauaagucugacugcaaucgcuaaccaggccgcgauuuugaugggacuggauaaaggcuggccaaucucgaagauggacauuggugucccucuccuggcucuugggugcuauagccaggugaauccguuaacacugaccgccgcaguucucauguugguggcccauuacgcuaucauaggccccggacugcaagcaaaagccaccagggaggcgcagaagcgcacagcugccggcauuaugaagaacccaacuguagaugggaucguggcaaucgaccuagauccugucguuuaugacgccaaauucgaaaagcagcugggacagauuaugcuccuuauccuguguacgucccaaauauugcugaugcggaccacaugggcucucugcgagucuauuacucuggccaccggccccuuaacaacccuuugggaggguucaccagggaaauuuuggaauacuacgaucgcagugagcauggcuaacauuuuccgaggauccuaccuggccggcgcgggucucgccuucagucuaaugaagucucugggcgggggaagaaggggcacaggggcacagggagaaaccuugggcgagaaauggaagcgccagcugaaucagcucagcaagucagaauuuaacacuuauaaacgguccgguauccuugaggucgacagaagugaagcuaaggaggggcugcguaggggagagaccacaaaacacgccgugagccggggcacugcaaaguugcgcugguucguagaacgaaaucuggugaaaccugaggguaagguuauagaucucggcugugggagaggaggcuggucuuacuauugcgcuggguuaaagaaagugaccgaagucaagggauacacaaaaggcggucccgggcacgaggaaccgaucccaauggccacguacggauggaaccuggugaagcuucauuccggcaaagacgucuuuuucauuccucccgagaagugugauacccugcuaugcgacaucggcgagucaagcccaaaucccacuauugaagaggggaggacacuccgggugcugaaaaugguugaaccuugguugcgcggaaaccaauuuuguaucaagauucugaauccguauaugcccucgguaguggagacccucgagcagaugcagagaaagcacgguggcaugcuugucaggaacccacugucucgaaauaguacucaugaaauguacuggguguccugcgggacaggaaacaucguuagcgccgugaauaugaccucacggauguuacugaaccguuucacgauggcgcacagaaaaccuaccuaugagcgcgaugucgacuugggcgcugguacaaggcacguggcaguagaacccgagguggccaaccucgauauaauugggcagcggaucgaaaauaucaagcaugagcacaaauccacuuggcauuacgacgaggauaacccuuauaagaccugggcuuaccacggaucuuaugaaguuaaaccaagcggcagugccuccagcauggucaauggcguggugaagcugcuaacaaagcccugggacgucauuccuaugguuacucaaauagcaaugaccgauacaaccccauuugggcagcagagaguguucaaagagaagguagacacucgcacgcccaaagccaagaggggaacagcucaaaucauggaagugaccgcgcgauggcuuugggguuuucugucucggaacaaaaagccgagaauuuguacuagggaggaauucacccgcaagguccguucaaaugccgcaaucggcgcuguguuuguugacgagaaccaguggaauagugccaaagaggcaguggaagaugagcgguucugggaccucguccauagagaaagggagcugcacaagcaggggaaaugcgccacaugcguguacaacaugaugggaaagcgcgaaaaaaaguugggcgaguuugguaaggcuaaagggucccgagccauuugguacauguggcugggagcgcgguuccucgaguucgaagcacuuggcuuuaugaaugaggaucacugguucagcagagaaaacucucugucgggcguagagggggagggauuacauaagcuggguuauaucuugagggacauaucaaaaaucccuggcgggaauauguacgccgaugacacggcuggaugggauacccgcauuacugaagacgaucuccagaacgaggccaagaucacagacauuauggaaccagagcacgcacugcuagcuaccagcaucuuuaaacuuacuuaucaaaauaagguugugagaguccagcggcccgccaaaaacggcacagugauggaugugauauccaggcgugaccagcgagguagugggcaggucggaaccuacggccugaauacauucacuaacauggaagcucaacucauucgccagauggagucugagggcaucuuuagcccuuccgaacuggagaccccaaacuuggccgaaagaguuuuagauuggcuggagaaguaugggguggaacggcucaagaggauggcaaucucaggagacgacuguguagugaaacccauugaugaccgcuucgcgacggcccuuaccgcucugaaugauauggguaaggucagaaaagacauaccgcagugggagccuaguaagggcuggaacgauuggcagcaagugcccuuuugcucucaucacuuccaccagcuaaucaugaaagacgggcgggagauuguugugccauguaggaaucaggaugaacuggucggacgagcccgugugagccagggcgcagguuggucccucagagagacagcuugcuuggggaagucauacgcccaaauguggcagcugauguauuuucaucgccgggaccuuaggcuggcagccaacgcgaucuguagcgcuguaccuuucgauuggguucccacuucuagaaccacaugguccauucacgcccaucaccaguggaugacuaccgaagacaugcucaguguguggaaucgcgucuggaucgaggaaaacccauggauggaggauaagacgcauauaagcucgugggaggacgugcccuacuuaggaaaacgggaagaccaauggugcggcucccugaucggcuugacagcaagggccaccugggcuacuaauauucagguugccaucaaccaggugcgaagacugauugggaaugagaacuaccucgauuauaugacaucuaugaagcgguuuaaaaaugaaucagacaccgagggagcacuuugguga

SEQ ID NO: 13293 - RNA, 9879 nt, Artificial Sequence
  derived and/or modified CDS sequence (opt3) from DENV-1__FJ639683__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacauccuucagcaugaccuguaucgcugugggccugguuacacuauaccucggggucauggugcaggccgauucuggaugcgugaucaacuggaaaggccgcgaacugaagugugguucagggauuuuugucacuaaugagguucacaccuggacggaacaauauaaguuccaggcagacaguccgaaaagacuuagcgccgcuauaggaaaggccugggaggagggcgugugcgguaucagguccgcaacacgguuggaaaacauuauguggaaacagaucucuaacgagcugaaucauauucuccuggaaaacgacaugaaguuuaccgugguagucggcgauguggcugggaucuuagcccagggcaagaagaugauacgcccucaacccauggaguacaaauauucguggaaaagcuggggcaaggcgaagaucauuggggccgacguucagaauacuaccuucaucauugauggaccaaacacaccugaaugucccgacgaucagagagcuuggaauaucugggagguggaggacuacggcuuugguauauucacuaccaacauuuggcugaaacuuagggauuccuauacacaggucugcgaccaccguuugaugucagcagccaucaaagauaguaaggcugugcacgccgacaugggguacuggauugaaucugagaaaaaugaaacguggaagcucgcacgggcgagcuucaucgagguuaagaccuguauauggccaaaaucccauacucuguggucaaacggagugcuagaaagcgagaugaucauucccaagaucuauggcgguccuauuucucaacacaauuaccgaccaggcuacuuuacacagaccgccgggccguggcaucugggaaaacucgagcuggauuucgaccuuugcgaaggcacuacaguagucguggaugagcacugcgggaacagaggacccuccuugaggaccacgacugugaccggcaagaucauacacgaaugguguugccgcaguuguacacugccuccauuacgguuuagaggugaggacgggugcugguauggaauggagauuaggcccgucaaagaaaaggaggaaaaucucguuaagagccuggugucugcuggcuccggugagguagacucauucagucuuggccuguuguguaucagcaucaugauugaagaggugaugcgcucgcgauggucccggaaaaugcucaugaccgggacucuggccgucuuucuacugcucaucaugggacagcugacauggaacgaucuuauucguuugugcauaauggugggcgcaaaugcuucugacagaauggggaugggaaccacauaccuggccuuaauggcaacuuucaagaugaggccuauguuugccguuggccuccuguuccgccggcuuaccagcagagaggugcugcuacucacgaucggucugucauuggucgcuaguguggaacugccaaacuccuuagaggaacucggggauggacuggcgaugggcauuaugauccuuaaacuguugacagacuuucaaucucaucagcucugggccacccugcuaagccugacuuucauuaagaccacauuuucccuucacuaugcauggaaaacuauggcuaugguucucucaaucgugagccuguuccccuugugucugaguaccacgucucagaagacaaccugguuaccgguccuccugggcucccuugggugcaagccucugacuauguuuuugauagccgagaauaaaaucuggggaaggcgaagcuggccacucaacgaagguauuauggccguaggcaucgugucgauucugcuaucaucucugcuuaagaacgauguuccccucgcugggccucugaucgcaggaggcauguugauagccuguuacgugauuagugguuccagcgcggacuuaucucuggagaaagcugccgaggucagcugggaagaggaagcagagcauuccggggccucacacaauauccucguggaaguacaggaugacggaacaaugaagaucaaagaugaggagcgcgacgauacccugacuauucuucugaaggcuacauugcuagcagugaguggcgucuauccccugagcauaccagccacccucuucguuugguacuucuggcagaagaagaagcagcggucuggcgugcugugggacacgccuucacccccagaaguggagagagcgguccuugaugacgggaucuauaggauuaugcagcguggauuacugggucgcagccaggugggcguugggguauuucaagaaaacguguuccauacuauguggcacgucacccggggagcugugcucauguaccagggcaaaagauuggagccgaguugggccagcguuaagaaagaccugaucuccuacggugggggauggaggcuccagggcucuuggaauacaggcgaggaagugcaggucauugcaguggagccugggaagaaccccaaaaauguacaaaccgccccaggaacauuuaagacucccgaaggugaggucggcgcuaucgcccuggauuucaagccugggaccucgggaagcccaauagugaaccgagaaggcaaaaucguuggucuuuaugggaauggaguggucacgacaucaggcacuuacguguccgcaauugcucaggccaaggcgagucaggagggcccccugccugagaucgaagacgagguuuuucggaaacgcaacuugaccauuauggaucuacacccggggucuggaaagacaagaagguaucugccagccaucgugcgggaagcaauaaaacgaaagcucagaaccuuaauucuggcucccacucgcgucguggccagcgagauggcugaagcacuuaaggguaugccuaucagguaccaaaccacagccguaaaauccgagcauacgggcaaggagaucguggaccugaugugccacgccacuuucaccaugcgucucuugucaccaguucggguccccaauuauaacaugauuaucauggaugaagcucauuuuacagacccuucuagcauagcggcaagaggguacauuaguaccagggugggaaugggcgaggccgcugccaucuucaugacugcaacaccgcccgguuccguggaagccuuuccacagagcaaugcugucauucaggaugaggaacgcgacaucccugagcgaucuuggaacucagggcacgaguggauaaccgauuuccccggaaaaacgguaugguuugugccauccauuaagaguggcaaugacaucgcgaacugucugaggaagaauggcaagcggguuauccagcucagcaggaagacuuucgauacagaauaucagaaaaccaagaacaacgacugggacuacguggucaccacugauauuucggagaugggggccaauuuccgcgcagaccgugugaucgauccuagacggugccugaaacccguuauucuuaaggacggaccagaaagggugauacuagcugguccgaugccugucacaguggccucugcagcccagcgccgaggcagaaucgggcggaaccauaauaaagagggagaucaguacauuuauaugggccagccccugaacaaugacgaggaucacgcucacuggaccgaagccaagauguuguuagacaacaucaauacaccagaggguaucauucccgcgcuguuugaaccugagagggaaaaguccgcagccauagauggggaguaccgccucagaggcgaggcuaggaaaacuuucguagaacugaugcggcguggagaccuuccaguguggcugagcuauaagguugccucagagggcuuucaauacagugaucgccgauggugcuucgacggggaaagaaacaaucagguccucgaggaaaacauggauguggagaucuggacgaaagagggagaaaggaagaaauugcggccccgcuggcuggacgcuagaaccuauucugacccucuagcacugagggaguuuaaggaguucgccgcuggucggcgauccgugagcggcgaucucauucuugagaucgggaaacugccgcagcauuuaacacagagagcccaaaaugcauuggacaaccuggucaugcuccacaauucagaacagggaggccgcgcguacaggcaugccauggaggagcugccagauacuauugaaacccuuaugcugcucgcuuugaucgccguucugacagguggggugaccuuauuuuuccuaaguggccggggacugggcaagacuagcauagggcuccuuuguguaauggcauccucugugcuguuguggauggcuagcgucgagccccacuggaucgccgcauccauuauccuggaauuuuuccucauggugcugcuuauuccugagcccgaccgucagagaacgccacaggauaaccaacucgccuauguugugaucggacuguuguuuaugauacugaccgucgcugcgaaugagauggguuuacuagaaacaacuaagaaagaccugggcauugggcacguagccgugggaaaccaucaccaugcagcuaugcucgauguugaccuucacccugccucagccuggacccuguacgcaguggcuacaaccaucauuacucccaugaugaggcauacaaucgagaacacgaccgccaauauaucuuugacugcgaucgcuaaccaggccgcaauucugaugggccucgauaaggguuggccaaucaguaaaauggacauuggggucccucugcuugccuuaggcugcuacucgcaagugaauccgcugacacucaccgcugcagucuugaugcugguggcccacuaugcgaucauaggacccggccuacaagcuaaggccacccgcgaagcacagaaacggacagccgcugggauuaugaagaacccaacuguugauggaaucguggccaucgaccuggauccuguaguguacgacgcaaaguucgagaaacagcucggccagauuaugcuucugaucuuguguacgagccaaauacugcucaugcgaaccacaugggcucugugcgaauccauuacuuuagccaccgguccccuuacaacccugugggaggggucuccaggaaaguuuuggaauacuacgaucgcggucucaauggccaacauuuucagaggcagcuaucucgcaggagcuggccuagccuucucccugaugaaaagucuagggggaggcaggcgcgggacaggagcacagggcgagacccugggugaaaaguggaaacggcagcucaaucagcuuucuaagagcgaguuuaacacuuacaagagaucagggaucauggaaguugaccguuccgaggcuaaagaaggacugaagaggggcgagaccacaaaacacgccgugagucgggguacugccaaguugcgcugguucgucgagcgaaaucuggugaaaccugaaggcaagguaauagaucucggguguggaagaggcggguggagcuauuacugcgcgggauuaaagaaagugaccgagguuaagggcuauacaaaaggugggcccggacaugaggaaccgaucccaauggcuacguacggcuggaaccuggugaaacuucacucuggcaaagacgucuuuuucgugccucccgaaaagugugauacccugcuaugcgacauuggggaguccucaccaaaucccacuaucgaggaaggaaggacacuccggguccugaaaaugguggagccuugguugcgcgguaaccaauuuuguauuaagauccugaauccguacaugcccagcguuguagaaacccucgagcagaugcagagaaagcauggcgggaugcuugugaggaacccacugucgcgaaauucuacucacgagauguauugggucaguugcggaacaggcaacauuguguccgcaguuaauaugaccagccggauguuacugaaccguuucacgauggcccacagaaaaccuaccuacgaacgcgauguggacuugggugcugggacaaggcaugucgccguggagcccgaaguagcaaaccucgauaucauaggacagcggauugagaauaucaagcacgaacauaaaucaacuuggcacuaugacgaggauaacccuuacaagaccugggccuaucauggcuccuacgaggugaaaccaucuggcagcgcuaguuccaugguuaauggggucgugaagcugcuaacaaagcccugggacgugaucccuauggucacucaaauugcgaugaccgauacaaccccauuuggacagcagagaguuuucaaagaaaagguggacacucgcacgcccaaagccaagagggguacagcacaaauaauggagguaaccgcuaaauggcuuuggggcuuucugagccgaaacaagaagccgcggaucuguacuagagaagaguucaccaggaaagugcgcucuaaugccgcaauuggggccgucuuuguggacgaaaaccaguggaacucagcuaaggaggccguugaggaugaacguuucugggaccucgugcaccgggagagagaacugcacaaacagggaaagugcgcgacaugcgucuauaacaugaugggcaaaagggagaagaaguugggugaauuugggaaagcaaagggaagucgcgccaucugguacauguggcugggcgcucgauuccucgaguucgaggcccuuggcuuuaugaaugaagaucauugguucucccgggagaacagccugucugggguggaaggagaggguuuacacaaacugggcuacauuuugagagacaucucgaagauaccugggggaaauauguaugcagaugacacggcuggcugggauaccaggaucacugaggacgaucuccagaacgaagcccgcauuacagacaucauggagccagaacaugcucugcuagccaaaucaauuuuuaaacuuaccuaccaaaauaaaguaguuagagugcagcggcccgcaaagaacgguacugucauggaugugaucagcaggcgugaccagcgaggguccggacaggugggcacauauggccugaauaccuucacaaacauggaggcgcaacucauacgccagauggaaagugaggggauauuuucuccuagcgagcuggaaacuccaaacuuggccgagagagucuuagauuggcuggaaaaguacggaguugagcggcucaaaaggauggcuaucuccggugacgacugugugguaaagcccaucgaugaccgcuucgccaccgcacuuacggcucugaaugauaugggcaaagugagaaaggacauuccgcagugggaaccuucaaaaggguggaacgauuggcagcaaguccccuuuugcagucaccacuuccaucagcuaauaaugaaggacggacgggagaucgugguuccauguaggaaucaggaugagcuggugggccgagcccgugucucucagggugcaggguggagccucagagaaaccgccugcuugggaaaguccuaugcgcaaauguggcagcugauguacuuucaccgccgggaccuuaggcuggcugccaacgcaauuuguucagccgugccuguagauuggauccccacaagcagaacuaccuggucuauucaugcucaccaucaguggaugacaacugaggacaugcucuccguuuggaaucgcguguggaucgaagagaacccauggauggaagauaaaacccacauaaguagcuggggcgacguccccuauuuaggcaagcgggaggaccaauggugcgggucgcugaucggauugacggccagggcaacaugggcuaccaauauucagguggccaucaaccagguucgaagacugauugguaaugagaacuaccucgauuacaugacuuccaugaaacgguucaagaaugaaucugacccugagggcgcgcuuugguga

SEQ ID NO: 13294 - RNA, 9879 nt, Artificial Sequence
  derived and/or modified CDS sequence (opt3) from DENV-1__FJ639684__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaacaugugcacacugauugccauggaccucggagaguucugugaagauacuaugaccuacaaaugcccacggauaagugaagcggaaccggacgauguggacuguuggugcaaugcuacagauaccuggguaacuuaugggacauguagccaaaccggagagcaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuuacugacuuccaaucccaucagcugugggccaccuugcucucacugacguuuaucaaaacaaccuucagccuacacuaugcauggaagacuauggcuauggugcugaguauugucucucuuuuuccccucugucuguccaccacaagccagaagacuaccugguugccgguacuguuaggcucgcucgggugcaaaccucugacgauguuccuuaucgccgagaauaagauauggggaagaaaaucauggccacugaacgaagguaucauggccgugggcauuguuucuaucuugcucaguucccugcuaaagaacgaugugccccuggcugggccucuuauugcaggaggcaugcucaucgccuguuacgucauaagcgguucuagcgcggaccuguccuuggagaaagcugccgaggugucaugggaagaggaagcagagcauaguggggccagccacaauauuuuaguagaagugcaggaugacggaacaaugaagaucaaagaugaggagagggacgauacccugacuauccuccugaaggcuacacuucuggcagucucuggcguuuaucccuuguccauuccagccacccuauucgugugguacuuuuggcaaaagaaaaagcagcgaucaggcgugcugugggacacuccuagucccccagaagucgagcgcgcggugcucgaugacgggauauaucggaucaugcagagaggacugcuugguaggagccagguuggcguagggguguuccaagaaaacgucuuucauacaauguggcacgugacccguggagcuguuuuaauguaccagggcaaacgccuggagccguccugggccucugugaagaaagaccucauuucguacggugggggauggcgguugcagggcagcuggaauacgggcgaggaaguccaggugaucgcaguagagccugggaagaaccccaagaauguccaaacugccccaggaaccuucaaaacaucagaaggugaggugggcgcuauugcccuggauuuuaagcccgggaccuccggaaguccuaucguuaacagagaaggcaaaauagugggucucuaugggaauggagucgugacaacuucuggcaccuacguuagcgcaaucgcucaggccaaggcgucccaggagggcccacugcccgagauugaagacgagguguucaggaaacgaaaccuuacgaucauggaucugcacccugggucaggaaagacacggcgcuauuugccggccauugucagagaagcaaucaagaggaaacuacggacucugauacucgcuccaacccgagugguagccucugagauggcugaagcauuaaaggguaugcccauuagauaccaaacaaccgccgugaaaagcgagcauacuggcaaggagaucguugaccugaugugccacgccaccuuuacaaugcgccuucugaguccugucagggugccaaauuauaacaugaucauuauggaugaagcucauuucacggaccccuccagcaucgcggcacguggguacauaucuacucgggugggaaugggcgaggccgcugccauuuuuaugaccgcaacaccuccggguucagucgaagccuucccccaguccaaugcuguaauccaggaugaggaaagagacauuccagagaggaguuggaacagcggguaugaguggaucaccgauuuuccuggaaaaacugugugguucguucccucgauaaagucuggcaaugacauugcgaacugucuccgcaagaauggcaaacgagugauccaguuguccagaaagacauucgauaccgaauaccagaagacgaagaacaacgacugggacuacgucgugacuacagauaucagcgagaugggggccaauuuucgggcagacaggguuauugauccacgccguugccugaaaccugugauccucaaggacggacccgaaagagucauucuggcugguccaaugccggugaccguagccucagcagcccagcggaggggccgcauagggcgaaaccacaauaaggagggagaucaguauaucuacaugggccagccucuuaacaaugacgaggaucaugcucacuggaccgaagccaaaaugcuacuggacaacauuaauacucccgaggguaucaucccagcguuguucgaacccgagagagaaaagagugcagccauugauggggaguaucgguuaaggggcgaggcucgcaaaacauuuguggaacugaugagaaggggagaccucccuguuuggcugucuuacaaggucgccuccgagggcuuccaauauagcgaucggcguuggugcuuugacggggaacgcaacaaucaggugcuugaggaaaacauggauguggagauauggaccaaagagggagaacgaaagaaacugagaccaagguggcucgacgcucggacauacucagaccccuuggcacugcgcgaguucaaggaauuugccgcugguagaaggagugucagcggcgaucuaauccuggagauugggaagcucccucagcaccuuacucagcgggcccaaaaugcacuggacaacuuaguuauguugcauaauuccgaacagggaggccgagcguauagacacgccauggaggagcugccggauacgaucgaaacccucaugcugcuugcucugauugccgugcucacaggugggguaacuuuguucuuucugucuggccgcggauuaggcaaaaccagcaucgggcuacugugugugauggcauccucaguccuccuuuggauggcuucuguggagccacauuggauagccgcaaguaucauucuggaguucuuuuugaugguucugcucauccccgagccugacaggcagcggacaccccaggauaaccaacuggccuacguggucauuggacuucucuucaugauccugaccguagcugcgaaugagauggguuugcuggaaacuacgaagaaagacuuaggcauagggcacguggccguugagaaccaccaucacgcagcuaugcuagauguggaccugcauccagccucggccuggacccucuacgcagucgcuacaacuauuaucaccccuaugaugcgucacacaauugaaaacaccacugccaauaucagccuuacagcgauagcuaaccaggccgcaauccugaugggauuggauaagggcuggcccauuuccaaaauggacaucggugugccacugcucgcccuggggugcuauucucaggucaauccucuuacguuaaccgcugcagugcugaugcucguugcccauuacgcgauuaucggcccgggauugcaagcuaaggccacuagagaggcacagaagaggacagccgcuggcauaaugaaaaaccccaccguggaugggauuguagccaucgaccuggauccaguggucuaugacgcaaaguuugaaaaacagcuaggacagaucaugcugcucauucuuuguaccucacaaauccuguugaugcgcacaacuugggcucugugcgagagcauaacgcucgccaccggcccucugacaacuuuaugggaggguucccccgggaaguucuggaauaccacaauugcgguuaguauggccaacaucuuccggggaucuuaccuugcaggcgcuggucuggccuuuagccucaugaaaucacuaggcgggggacgaagaggcaccggggcacagggagaaacucugggcgagaaguggaagaggcaguugaaucagcuguccaaaagugaguucaacacguauaagcgcagcgguauuauggagguggaccggucugaagcuaaagaggggcucaagagaggagagacaaccaaacacgccgucucccguggcacugccaaacuuaggugguuuguggaacggaaucugguaaagccagaggguaaagugaucgauuugggcugugggcgcggaggcuggucauacuauugcgcggggcugaagaaaguuaccgaagugaagggauacacaaaaggcgguccugggcacgaggaacccauaccgauggcuacuuacggauggaaccucgucaaguuacauagcggcaaagacguguucuuugucccaccugagaagugugauacccugcuuugcgacaucggcgagucgucucccaauccaacaauugaagaggggcgaacgcugagagugcuaaagaugguugaacccuggcucaggggaaaccaauucuguaucaaaauucugaauccuuauaugccgaguguaguggagaccuuggagcagaugcagcggaagcacgguggcaugcugguccgcaacccccucuccagaaauagcacucaugaaauguacugggugucaugcgggacaggaaacaucguuuccgcagugaauaugaccucuaggaugcuucugaaccgauuuacuauggcccaccggaaaccaacauaugagcgugaugucgacuuaggcgcugguaccagacacguggccguagaaccugagguggcaaaccuggauauuaucgggcagcgcauagaaaauauuaagcaugagcacaaaagcacguggcauuacgacgaggauaaccccuauaagaccugggccuaccacggaaguuaugaaguuaagccuuccggcagcgcuucuucaauggucaauggcguggugaaauugcucacaaagccaugggacgucauccccaugguuacucaaaucgcgaugaccgauacaacuccuuucgggcagcagaggguguuuaaagagaagguagacacccggacaccaaaagccaagagaggaaccgcacaaauuauggaagugacugcuaaguggcugugggguuuccuaagucgcaacaaaaagcccaggauauguacgcgagaggaauuuacacggaaagucagauccaaugccgcaaucggcgccguguucguugacgagaaccaguggaauagcgcuaaggaggccguggaagaugagagguuuugggaccuuguccaucgcgaacgugagcugcacaaacaggggaagugcgcgaccugcguguacaacaugaugggaaagcgggagaaaaagcucggcgaguucgguaaagcaaaggggucuagagccauuugguacauguggcugggagcuagguucuuggaguuugaagcccugggcuucaugaaugaggaucacugguuuucgcgcgaaaacucacucagcggcguagagggggagggacuucauaaacuggguuauaucuuacgagacauuuccaagaucaguggcgggaauauguacgcagaugacacugcuggaugggauacccggauaacagaagacgaucugcagaacgaggccaaaaucacggacauuauggaaccggagcacgcuuugcucgccaagucuaucuucaagcugaccuaucaaaauaaaguugugagaguccagaggccugcaaagaacggcacugugauggaugugauuagccgcagagaccagcgggguuccgggcaggucggaacauacggccuaaauaccuuuacuaacauggaagcgcaacuuaucaggcagauggagucagagggcauauucaguccaucugaacuggagacacccaaccucgccgaacgugcucuggauugguuggagaaacaugggguugaacgauuaaagcgcauggccauuagcggagacgacugugugguaaaaccuaucgaugacagauuugcaaccgcucugacagcccucaaugauauggguaaggugcggaaggacaucccacagugggagcccuccaaaggcuggaacgauuggcagcaagucccguucugcucacaccacuuucaucagcuuauuaugaaggacgggagggagauagugguuccuugucgcaaucaggaugaacuggugggcagagcacgggucagccagggcgccgguuggucucuaagggagacugcgugccuggggaaauccuaugcucaaauguggcagcucauguacuuccaccgacgugacuugagacuggccgcaaacgccaucuguagugcugugcccguagauuggguuccaaccagccgcacgaccuggucgauucaugcccaccaucaguggaugacaacugaagacaugcuuuccguguggaaucgggucuggaucgaggaaaacccuuggauggaggauaagacccacauuucuucaugggaggacgugcccuaucugggaaaaagggaagaccaauggugcggcagccucaucggcuuaacagcaagagcuacuugggccaccaauauacagguugcgaucaaccaggugcgccggcugauugggaaugagaacuacuuggauuacaugacgaguaugaagagguuuaagaaugaauccgucccagagggagcucugugguga

SEQ ID NO: 13295 - RNA, 9879 nt, Artificial Sequence
  derived and/or modified CDS sequence (opt3) from DENV-1__FJ639685__SS-prME
uccgugaccaugcugcucaugcuuaugcccacagcacuggcuuuccacuugacuacgagaggaggggagccucauaugaucgucuccaagcaagaaagaggaaaaucuuuacuguuuaagaccucagccgguguuaauaugugcacacuaauugccauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacggaacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacauccuucagcaugaccuguaucgcugugggccugguuacacuauaccucggggucauggugcaggccgauucuggaugcgugaucaacuggaaaggccgcgaacugaagugugguucagggauuuuugucacuaaugagguucacaccuggacggaacaauauaaguuccaggcagacaguccgaaaagacuuagcgccgcuauaggaaaggccugggaggagggcgugugcgguaucagguccgcaacacgguuggaaaacauuauguggaaacagaucucuaacgagcugaaucauauucuccuggaaaacgacaugaaguuuaccgugguagucggcgauguggcugggaucuuagcccagggcaagaagaugauacgcccucaacccauggaguacaaauauucguggaaaagcuggggcaaggcgaagaucauuggggccgacguucagaauacuaccuucaucauugauggaccaaacacaccugaaugucccgacgaucagagagcuuggaauaucugggagguggaggacuacggcuuugguauauucacuaccaacauuuggcugaaacuuagggauuccuauacacaggucugcgaccaccguuugaugucagcagccaucaaagauaguaaggcugugcacgccgacaugggguacuggauugaaucugagaaaaaugaaacguggaagcucgcacgggcgagcuucaucgagguuaagaccuguauauggccaaaaucccauacucuguggucaaacggagugcuagaaagcgagaugaucauucccaagaucuauggcgguccuauuucucaacacaauuaccgaccaggcuacuuuacacagaccgccgggccguggcaucugggaaaacucgagcuggauuucgaccuuugcgaaggcacuacaguagucguggaugagcacugcgggaacagaggacccuccuugaggaccacgacugugaccggcaagaucauacacgaaugguguugccgcaguuguacacugccuccauuacgguuuagaggugaggacgggugcugguauggaauggagauuaggcccgucaaagaaaaggaggaaaaucucguuaagagcauggugucugcuggcuccggugagguagacucauucagucugggccuucuguguaucagcaucaugauugaagaggugaugcgcucgcgauggucccggaaaauguugaugaccgggacucucgccgucuuucugcuacugaucaugggacagcucacauggaacgaucugauucgucuuugcauaauggugggcgcaaaugcuucugacagaauggggaugggaaccacauacuuggcccugauggcaacuuucaagaugaggccuauguuugccguuggcuuacucuuccgccggcugaccagcagagaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaagaccacauuuucccugcacuaugcauggaaaacuauggcuaugguucuuucaaucgugagccucuucccccuguguuugaguaccacgucucagaagacaaccuggcugccggucuuacucggcucccuggggugcaagccucuuacuauguuucugauagccgagaauaaaaucuggggaaggcgaagcuggccauugaacgaagguauuauggccguaggcaucgugucgauucuccugucaucucuacugaagaacgauguuccccuugcugggccucucaucgcaggaggcaugcugauagccuguuacgugauuagugguuccagcgcggacuugucuuuagagaaagcugccgaggucagcugggaagaggaagcagagcauuccggggccucacacaauauccugguggaaguacaggaugacggaacaaugaagaucaaagaugaggagcgcgacgauacccucacuauucugcuuaaggcuacacuguuggcagugaguggcgucuauccccuaagcauaccagccacccuguucguuugguacuucuggcagaagaagaagcagcggucuggcgugcucugggacacgccuucacccccagaaguggagagagcgguccuggaugacgggaucuauaggauuaugcagcguggacuuuuaggucgcagccaggugggcguugggguauuucaagaaaacguguuccauacuauguggcacgucacccggggagcugugcugauguaccagggcaaaagacucgagccgaguugggccagcguuaagaaagacuugaucuccuacggugggggauggaggcugcagggcucuuggaauacaggcgaggaagugcaggucauugcaguggagccugggaagaaccccaaaaauguacaaaccgccccaggaacauuuaagacucccgaaggugaggucggcgcuaucgcccucgauuucaagccugggaccucgggaagcccaauagugaaccgagaaggcaaaaucguuggucuguaugggaauggaguggucacgacaucaggcacuuacguguccgcaauugcucaggccaaggcgagucaggagggcccccuuccugagaucgaagacgagguuuuucggaaacgcaaccugaccauuauggauuugcacccggggucuggaaagacaagaagguaucuaccagccaucgugcgggaagcaauaaaacgaaagcugagaacccucauuuuagcucccacucgcgucguggccagcgagauggcugaagcacugaaggguaugccuaucagguaccaaaccacagccguaaaauccgagcauacgggcaaggagaucguggaccuuaugugccacgccacuuucaccaugcgucugcucucaccaguucggguccccaauuauaacaugauuaucauggaugaagcucauuuuacagacccuucuagcauagcggcaagaggguacauuaguaccagggugggaaugggcgaggccgcugccaucuucaugacugcaacaccgcccgguuccguggaagccuuuccacagagcaaugcugucauucaggaugaggaacgcgacaucccugagcgaucuuggaacucaggguaugaguggauaaccgauuuccccggaaaaacgguaugguuugugccauccauuaagaguggcaaugacaucgcgaacuguuugaggaaaaauggcaagcggguuauccagcugagcaggaagacuuucgauacagaauaccagaaaaccaagaacaacgacugggacuacguggucaccacugauauuucggagaugggggccaauuuccgcgcagaccgugugaucgauccuagacggugccucaaacccguuauucugaaggacggaccagaaagggugauacuugcugguccgaugccugucacaguggccucugcagcccagcgccgaggcagaaucgggcggaaccacaauaaagagggagaucaguauauuuacaugggccagccccuaaacaaugacgaggaucaugcucacuggaccgaagccaagaugcuguuggacaacaucaauacaccagaggguaucauucccgcguuauuugaaccugagagggaaaaguccgcagccauagauggggaguaucgccugagaggcgaggcuaggaaaacuuucguagaacucaugcggcguggagaccugccaguguggcuuagcuacaagguugccucagagggcuuucaauauagugaucgccgauggugcuucgacggggaaagaaacaaucagguccuggaggaaaacauggauguggagaucuggacgaaagagggagaaaggaagaaacuccggccccgcugguuggacgcuagaaccuacucugacccucuggcacuaagggaguuuaaggaguucgccgcuggucggcgauccgugagcggcgaucugauucucgagaucgggaaacuuccgcagcaccugacacagagagcccaaaaugcauuagacaacuuggucaugcugcauaauucagaacagggaggccgcgcguauaggcacgccauggaggagcucccagauacuauugaaacccugaugcuucuggcucucaucgccguuuugacagguggggugacccuguuuuucuuaaguggccggggacuaggcaagacuagcauagggcugcucuguguaauggcauccucugugcuucuguggauggcuagcgucgagccccauuggaucgccgcauccauuaucuuggaauuuuuccugauggugcuccugauuccugagcccgaccgucagagaacgccacaggauaaccaacuugccuacguugugaucggacuccuguuuaugauauugaccgucgcugcgaaugagaugggucuguuagaaacaacuaagaaagaccuaggcauugggcacguagccgcaggaaaccaccaucacgcugccaugcuggauguggaccuccauccugccucagcauggacccuuuacgcuguugccacaaccaucauuacucccaugaugaggcacacaaucgagaacacgaccgcgaauauaucucugacugcuaucgccaaccaggcagccauuuugaugggccuggauaaggguuggccaaucaguaaaauggacauuggggugccucuccuggcucuuggcugcuauucgcaggucaauccguuaacacugaccgcagccgugcucauguuggucgcgcauuacgcuaucauaggacccggccugcaagccaaggcaacccgcgaagcccagaaacggacagcugccgggauuaugaagaacccaacuguggauggaaucguugcaaucgaccuagauccugugguauaugacgcuaaguucgagaaacagcugggccagauuaugcuccuuauccuguguacgagccaaauauugcugaugcgaaccacaugggcccucugcgaauccauuacucuggcgaccggucccuuaacaacccuuugggaggggucuccaggaaaguuuuggaauacuacgaucgccgugucaauggcaaacauuuucagaggcagcuaccuggcuggugccggccucgcauucuccgucaugaaaagucuagggggaggcaggcgcgggacaggagcucagggcgagacccugggugaaaaguggaaacggcaguugaaucagcugucuaagagcgaguuuaacacuuauaagagaucagggaucauggaaguugaccguuccgaggccaaagaaggacucaagaggggcgagaccacaaaacacgccgugagucgggguacugcgaaacuucgcugguucgucgagcgaaaucuggugaaaccugaaggcaagguaauagauuugggguguggaagaggcggguggagcuacuauugcgcuggacugaagaaagugaccgagguuaagggcuacacaaaaggugggcccggacacgaggaaccgaucccaauggcaacguacggcuggaaccucgugaaguuacauucuggcaaagacgucuuuuucgugccucccgaaaagugugauacccugcuuugcgacauuggggaguccucaccaaaucccacuaucgaggaaggaaggacacugcggguccuaaaaaugguggagccuuggcuccgcgguaaccaauuuuguauuaagauccugaauccguauaugcccagcguuguagaaaccuuggagcagaugcagagaaagcacggcgggaugcuggugaggaacccacucucgcgaaauucuacucaugagauguacugggucaguugcggaacaggcaacauuguguccgccguuaauaugaccagccggaugcuucugaaccguuucacgauggcucacagaaaaccuaccuaugaacgcgauguggacuuaggugccgggacaaggcacgucgcaguggagcccgaaguagccaaccuggauaucauaggacagcggauugagaauaucaagcaugaacacaaaucaacuuggcauuacgacgaggauaacccuuauaagaccugggcuuaccacggcuccuaugaggugaaaccaucuggcagcgcgaguuccaugguuaauggggucgugaaguugcucacaaagcccugggacgugaucccuauggucacucaaauugccaugaccgauacaaccccauuuggacagcagagaguuuucaaagaaaagguggacacucgcacgcccaaagcaaagagggguacagcucaaauaauggagguaaccgccaaauggcuguggggcuuucuaagccgaaacaagaagccgcggaucuguacuagagaagaguucaccaggaaagugcgcucuaaugcagccauuggggcugucuuuguggacgaaaaccaguggaacucagccaaggaggcgguugaggaugaacguuucugggaccuugugcaucgggagagagaacugcacaaacagggaaagugcgcaacaugcgucuacaacaugaugggcaaaagggagaagaagcucggugaauuugggaaagccaagggaagucgcgcuaucugguacauguggcugggcgcccgauucuuggaguucgaggcacugggcuuuaugaaugaagaucacugguucucccgggagaacagccucucugggguggaaggagagggucuucauaaacugggcuauauuuuaagagacaucucgaagauaccugggggaaauauguacgcugaugacacggccggcugggauaccaggaucacugaggacgaucugcagaacgaagcucgcauuacagacaucauggagccagaacacgccuugcucgcaaaaucaauuuuuaagcugaccuaucaaaauaaaguaguuagagugcagcggcccgcgaagaacgguacugucauggaugugaucagcaggcgugaccagcgaggguccggacaggugggcacauacggccuaaauaccuucacaaacauggaggcccaacuuauacgccagauggaaagugaggggauauuuucuccuagcgagcuggaaacuccaauccucgcugagagaguccuggauugguuggaaaaguauggaguugagcgguuaaaaaggauggccaucuccggugacgacugugugguaaagcccauugaugaccgcuucgcaaccgcucugacggcccucaacgauaugggcaaagugagaaaggacauaccgcagugggaaccuucaaaaggguggaaugauuggcagcaaguccccuuuugcagucaucacuuccaccagcuuaucaugaaggacggacgggagauugugguuccauguaggaaccaggaugagcuggugggccgagcacgugucucucagggugccggguggagccuaagagaaaccgcgugccugggaaaguccuacgcucaaauguggcagcucauguauuuucaucgccgggacuugaggcuggccgcaaaugccaucuguucagcugugccuguagauuggauucccacaagcagaacuaccuggucuauccacgcccaucaccaguggaugacaacugaggacaugcuuuccguuuggaaccgcguguggauagaagagaauccauggauggaagauaaaacccauaucaguagcuggggcgacguccccuaccugggcaagcgggaggaccaauggugcgggucgcucauuggauuaacggcaagggcuacaugggccaccaacauccagguggcgauuaaucagguucgaagacugaucgguaacgagaauuacuuggauuauaugacuuccaugaaacgguucaagaacgaaucugacccugagggcgcucugugguga

SEQ ID NO: 13296 - RNA, 9879 nt, Artificial Sequence
  derived and/or modified CDS sequence (opt3) from DENV-1__FJ639686__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaacaugugcacacugauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcacuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacuggaucguucaaacuggagaaggaaguggcugagacccagcacgguacgguccuugugcagauccgcuacgagggcacagacgcgccuugcaagauuccauucucgacccaagaugaaagagggguuacucagaacggaagguugaucacagcaaaucccauagugaccgacaaagagaagccuguaaacauugaagccgagccacccuuuggcgagucuuauaucgucaucggugcuggggaaaaagcccugaagcucuccugguucaaaaagggcucaaguauuggaaagauguuugaggcaacugcccggggcgcucgacgcauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucaagaaguacauccuucagcaugaccuguaucgcugugggccugguuacacuauaccucggggucauggugcaggccgauucuggaugcgugaucaacuggaaaggcagggaacugaagugugguucagggauuuuugucacuaaugagguucacaccuggacggaacaauauaaauuccaggcagacaguccgaagcggcuuagcgccgcuauaggaaaggccugggaggagggcgugugcgguauccgcuccgcaacaagauuggaaaacauuauguggaaacagaucucuaacgagcugaaucauauucuccuggaaaacgacaugaaguuuaccgugguagucggcgauguggcugggaucuuagcccagggcaagaagaugauaaggccucaacccauggaguacaaauauucguggcguagcuggggcaaggcgaaaaucauuggggccgacguucagaauacuaccuucaucauugauggaccaaacacaccugaaugucccgacgaucagcgggcuuggaauaucugggagguggaggacuacggcuuugguauauucacuaccaacauuuggcugaaacuucgagauuccuauacacaggucugcgaccacagauugaugucagcagccaucaaggauaguaaagcugugcacgccgacaugggguacuggauugaaucugagaagaaugaaacguggaaacucgcaagggcgagcuucaucgagguuaagaccuguauauggccaaaaucccauacucuguggucaaacggagugcuagaaagcgagaugaucauucccaagaucuauggcgguccuauuucucaacacaauuaccgcccaggcuacuuuacacagaccgccgggccguggcaucugggaaagcucgagcuggauuucgaccuuugcgaaggcacuacaguagucguggaugagcacugcgggaaccggggacccuccuugagaaccacgacugugaccggcaaaaucauacacgaaugguguugcaggaguuguacacugccuccauuacgcuuucgaggugaggacgggugcugguauggaauggagauucggcccgucaaggaaaaagaggaaaaucucguuaagagcauggugucugcuggcuccggugagguagacucauucagucugggccuucuguguaucagcaucaugauugaagaggugaugcguucgagaugguccaggaaaauguugaugaccgggacucucgccgucuuucugcuacugaucaugggacagcucacauggaacgaucugauucgccuuugcauaauggugggcgcaaaugcuucugaccggauggggaugggaaccacauacuuggcccugauggcaacuuucaagaugagaccuauguuugccguuggcuuacucuucaggcgacugaccagccgcgaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaaaaucuggggacggagaagcuggccauugaacgaagguauuauggccguaggcaucgugucgauucuccugucaucucuacugaagaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacaaugaaaaucaaggaugaggagagggacgauacccucacuauucugcuuaaagcuacacuguuggcagugaguggcgucuauccccuaagcauaccagccacccuguucguuugguacuucuggcaaaagaaaaagcagcguucuggcgugcucugggacacgccuucacccccagaaguggagcgcgcgguccuggaugacgggaucuaucggauuaugcagagaggacuuuuagguaggagccaggugggcguugggguauuucaagaaaacguguuccauacuauguggcacgucacccgaggagcugugcugauguaccagggcaaacggcucgagccgaguugggccagcguuaagaaggacuugaucuccuacggugggggauggcgccugcagggcucuuggaauacaggcgaggaagugcaggucauugcaguggagccugggaaaaaccccaagaauguacaaaccgccccaggaacauuuaaaacucccgaaggugaggucggcgcuaucgcccucgauuucaagccugggaccucgggaagcccaauagugaacagagaaggcaaaaucguuggucuguaugggaauggaguggucacgacaucaggcacuuacguguccgcaauugcucaggccaaggcgagucaggagggcccccuuccugagaucgaagacgagguuuuuaggaagcggaaccugaccauuauggauuugcacccggggucuggaaaaacacgaagauaucuaccagccaucgugcgcgaagcaauaaagaggaaacugcguacccucauuuuagcucccacucgggucguggccagcgagauggcugaagcacugaaggguaugccuaucagauaccaaaccacagccguaaaauccgagcauacgggcaaggagaucguggaccuuaugugccacgccacuuucaccaugaggcugcucucaccaguucgcguccccaauuauaacaugauuaucauggaugaagcucauuuuacagacccuucuagcauagcggcacgaggguacauuaguaccagagugggaaugggcgaggccgcugccaucuucaugacugcaacaccgcccgguuccguggaagccuuuccacagagcaaugcugucauucaggaugaggaacgggacaucccugagaggucuuggaacucaggguaugaguggauaaccgauuuccccggaaagacgguaugguuugugccauccauuaaaaguggcaaugacaucgcgaacuguuugcgcaagaauggcaaacguguuauccagcugagcagaaagacuuucgauacagaauaccagaagaccaagaacaacgacugggacuacguggucaccacugauauuucggagaugggggccaauuuccgggcagacagggugaucgauccucgccgaugccucaagcccguuauucugaaagacggaccagaaagagugauacuugcugguccgaugccugucacaguggccucugcagcccagcggaggggccgcaucgggagaaaccacaauaaggagggagaucaguauauuuacaugggccagccccuaaacaaugacgaggaucaugcucacuggaccgaagccaaaaugcuguuggacaacaucaauacaccagaggguaucauucccgcguuauuugaaccugagagggaaaaguccgcagccauagauggggaguaucggcugcguggcgaggcucgcaaaacuuucguagaacucaugcgaagaggagaccugccaguguggcuuagcuacaagguugccucagagggcuuucaauauagugauaggcgguggugcuucgacggggaacgcaacaaucagguccuggaggaaaacauggauguggagaucuggacgaaggagggagaaaggaagaagcucaggccccggugguuggacgcucgaaccuacucugacccucuggcacuaagagaguuuaaagaguucgccgcuggucgcagguccgugagcggcgaucugauucucgagaucgggaaacuuccgcagcaccugacacagcgggcccaaaaugcauuagacaacuuggucaugcugcauaauucagaacagggaggccgugcguauagacacgccauggaggagcucccagauacuauugaaacccugaugcuucuggcucucaucgccguuuugacagguggggugacccuguuuuucuuaaguggcaggggacuaggcaaaacuagcauagggcugcucuguguaauggcauccucugugcuucuguggauggcuagcgucgagccccauuggaucgccgcauccauuaucuuggaauuuuuccugauggugcuccugauuccugagcccgaccgccagcggacgccacaggauaaccaacuugccuacguugugaucggacuccuguuuaugauauugaccgucgcugcgaaugagaugggucuguuagaaacaacuaagaaagaccuaggcauugggcacguagccgugggaaaccaccaucacgcagcuaugcuggauguugaccuccauccugccucagccuggacccuuuacgcaguggcuacaaccaucauuacucccaugaugcgacacacaaucgagaacacgaccgccaauauaucucugacugcgaucgcuaaccaggccgcaauuuugaugggccuggauaaggguuggccaaucaguaagauggacauuggggucccucuccuggcccuuggcugcuauagccaggugaauccguuaacacugaccgcugcaguccucauguugguggcccauuacgcgaucauaggacccggccugcaagcuaaagccaccagagaagcacagaagaggacagccgcugggauuaugaaaaacccaacuguugauggaaucguggccaucgaccuagauccuguaguguaugacgcaaaguucgagaaacagcugggccagauuaugcuccuuauccuguguacgagccaaauauugcugaugcgcaccacaugggcucucugcgaauccauuacucuggccaccggucccuuaacaacccuuugggaggggucuccaggaaaguuuuggaauacuacgaucgcggucucaauggccaacauuuuccggggcagcuaccuggccggugcuggccucgccuucucccuaaugaagagucuagggggaggcagacgugggacaggagcacagggcgagaccuugggugaaaaauggaagaggcagcugaaucagcucucuaaaagcgaguuuaacacuuauaagcggucagggaucauggaaguugaccgcuccgaggcuaaagaaggacuuaagcgaggcgagauaaccaagcacgccgugaguagagguacagccaaacugaggugguucgucgagcggaauuuggugaagccugaaggcaaaguaaucgaucugggguguggacgcggcggguggagcuacuauugcgcgggacucaagaaagugacugagguuaagggcuacaccaagggugggcccggacacgaggaaccgauuccaauggcuacauacggcuggaacuuagugaaacugcauucuggcaaggacgucuuuuucgugccucccgaaaaaugugauacgcuucugugcgacaucggggaguccucaccaaaucccaccauugaggaaggaagaacucuaaggguccucaagaugguggagccuuggcugcgagguaaccaauuuuguaucaaaauuuugaauccguauaugcccagcguuguagaaacacuggagcagaugcagcggaagcacggcgggaugcucgugcguaacccacuuucgagaaauucuacccaugagauguacugggucaguugcggaacuggcaacaucguguccgcaguuaauaugacaagccgcaugcuguuaaacagguucaccauggcccaccggaaaccuacguaugaaagagauguggaccugggugcugggacccgccacgucgccguggagcccgaaguagcaaacuuggauauaauuggacagaggaucgagaauaucaagcaugaacacaagucaacauggcauuacgacgaggauaacccuuauaaaacuugggccuaccacggcuccuaugaggugaagccaucuggcagcgcuaguuccaugguuaauggggucgugaaacuccugaccaagcccugggacgugauuccuauggucacacaaauagcgaugacugauaccacaccauuuggacagcagcgaguuuucaaagaaaagguggacacccggacucccaaggccaaaagagguacggcacaaaucauggagguaacagcuaaguggcuauggggcuuucuuagcaggaacaaaaagccgcgcauuuguacccgugaagaguucacucggaaagugagaucuaaugccgcaaucggggccgucuuuguggacgaaaaccaguggaacucagcuaaggaggccguugaggaugaaagguucugggaccuggugcaucgcgagcgagaacuccacaagcagggaaaaugcgcgaccugcgucuacaacaugaugggcaagcgggagaaaaagcugggugaauuugggaaagcaaagggaaguagagccauuugguacaugugguugggcgcuagguuccuggaguucgaggcccucggcuuuaugaaugaagaucacugguucucccgcgagaacagccuuucugggguggaaggagagggucugcauaaguuaggcuauauccugagagacauaucgaaaaucccugggggaaauauguacgcagaugacacagcuggcugggauacgcggauuaccgaggacgauuugcagaacgaagccaggaucacugacauuauggagccagaacacgcucuccuggccaagucaaucuuuaaacuaacauaucaaaauaagguaguucgugugcagcgacccgccaaaaaugguaccgucauggaugugauaagccgcagagaccagcggggguccggacaggugggcacuuacggccuuaauacauucaccaacauggaggcgcaacugauuaggcagauggaaagugaggggaucuuuucuccuagcgagcucgaaacaccaaaccuggccgagcgcgucuuggauugguuagaaaaguauggaguugagagacugaaacggauggcuaucuccggugacgacugugugguaaagcccauugaugacagguucgccacugcacucaccgcucuuaaugauaugggcaaggugcgaaaagacauaccgcagugggaaccuucaaagggguggaacgauuggcagcaaguccccuuuugcagucaucacuuccaccagcugaucaugaaagacggacgugagauugugguuccauguagaaaucaggaugagcuagugggccgcgcccgggucucucagggugcaggguggagccugagggaaacggccugccucggaaaguccuacgcgcaaauguggcaguugauguauuuucauagacgcgaccugcggcuugcugccaacgcaaucuguucagccgugccuguagauuggauucccaccagcaggacaacuuggucuauccacgcucaucaccaguggaugaccacagaggacaugcuguccguuuggaaucgaguguggauagaagagaacccauggauggaagauaaaacucauaucaguagcuggggcgacguccccuaccucggcaagagagaggaccaauggugcgggucguuaauuggacugaccgcccgggcaacgugggcuacaaauauccagguggccauuaaccagguuaggcgcuugaucgguaaugagaacuaccuggauuauaugaccuccaugaagcguuucaaaaaugaaucugacccugagggcgcgcucugguga

SEQ ID NO: 13297 - RNA, 9879 nt, Artificial Sequence
  derived and/or modified CDS sequence (opt3) from DENV-1__FJ639687__SS-prME
agcgugaccaugcugcucaugcuuaugcccaccgcccuggcuuuccacuugacuacgagaggaggggaaccucauaugaucgucuccaagcaggaaagggggaaaucuuuacuguuuaagaccucagccgguguuaacaugugcacacugauugccauggaccucggagaguucugugaagauacuaugaccuacaaaugcccacggauaagugaagcggaaccggacgauguggacuguuggugcaaugcuacagauaccuggguaacuuaugggacauguagccaaaccggagaacaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuuacugacuuccaaucccaucagcugugggccaccuugcucucacugacguuuaucaaaacaaccuucagccuacacuaugcauggaagacuauggcuauggugcugaguauugucucucuuuuuccccucugucuguccaccacaagccagaagacuaccugguugccgguacuguuaggcucgcucgggugcaaaccucugacgauguuccuuaucgccgagaauaagauauggggaagaaaaucauggccacugaacgaagguaucauggccgugggcauuguuucuaucuugcucaguucccugcuaaagaacgaugugccccuggcugggccucuuauugcaggaggcaugcucaucgccuguuacgucauaagcgguucuagcgcggaccuguccuuggagaaagcugccgaggugucaugggaagaggaagcagagcauaguggggccagccacaauauuuuaguagaagugcaggaugacggaacaaugaagaucaaagaugaggagagggacgauacccugacuauccuccugaaggcuacacuucuggcagucucuggcguuuaucccuuguccauuccagccacccuauucgugugguacuuuuggcaaaagaaaaagcagcgaucaggcgugcugugggacacuccuagucccccagaagucgagcgcgcggugcucgaugacgggauauaucggaucaugcagagaggacugcuugguaggagccagguuggcguagggguguuccaagaaaacgucuuucauacaauguggcacgugacccguggagcuguuuuaauguaccagggcaaacgccuggagccguccugggccucugugaagaaagaccucauuucguacggugggggauggcgguugcagggcagcuggaauacgggcgaggaaguccaggugaucgcaguagagccugggaagaaccccaagaauguccaaacugccccaggaaccuucaaaacaucagaaggugaggugggcgcuauugcccuggauuuuaagcccgggaccuccggaaguccuaucguuaacagagaaggcaaaauagugggucucuaugggaauggagucgugacaacuucuggcaccuacguuagcgcaaucgcucaggccaaggcgucccaggagggcccacugcccgagauugaagacgagguguucaggaaacgaaaccuuacgaucauggaucugcacccugggucaggaaagacacggcgcuauuugccggccauugucagagaagcaaucaagaggaaacuacggacucugauacucgcuccaacccgagugguagccucugagauggcugaagcauuaaaggguaugcccauuagauaccaaacaaccgccgugaaaagcgagcauacuggcaaggagaucguugaccugaugugccacgccaccuuuacaaugcgccuucugaguccugucagggugccaaauuauaacaugaucauuauggaugaagcucauuucacggaccccuccagcaucgcggcacguggguacauaucuacucgggugggaaugggcgaggccgcugccauuuuuaugaccgcaacaccuccggguucagccgaggcuuucccccaguccaaugcggucauccaggaugaggaaagagacauuccagagaggaguuggaacagcggguaugaguggaucaccgauuuuccuggaaaaacuguaugguucgugcccucgauaaagucuggcaaugacauugccaacugucuccgcaagaauggcaaacgaguuauccaguuguccagaaagacauucgauaccgaauaccagaagacgaagaacaacgacugggacuacguggucacuacagauaucagcgagaugggggcaaauuuucgggcugacagggugauugauccacgccguugccugaaaccuguuauccucaaggacggacccgaaagagugauucuggccgguccaaugccggucaccguggcaucagccgcucagcggaggggccgcauagggcgaaaccacaauaaggagggagaucaguauaucuacaugggccagccucuuaacaaugacgaggaucaugcccacuggaccgaagcgaaaaugcuacuggacaacauuaauacucccgaggguaucaucccagcauuguucgaacccgagagagaaaagagugccgcuauugauggggaguaucgguuaaggggcgaggcccgcaaaacauuuguagaacugaugagaaggggagaccucccuguguggcugucuuacaagguugcuuccgagggcuuccaauauagcgaucggcguuggugcuuugacggggaacgcaacaaucagguccuugaggaaaacauggauguggagauauggaccaaagagggagaacgaaagaaacugagaccaagguggcucgacgcacggacauacucagaccccuuggcccugcgcgaguucaaggaauuugcugccgguagaaggagugugagcggcgaucuaauccuggagauugggaagcucccucagcaccuuacucagcgggcacaaaaugcgcuggacaacuuagucauguugcauaauuccgaacagggaggccgagccuauagacacgcuauggaggagcugccggauacgaucgaaacccucaugcugcuugcccugauugcaguucucacagguggggugacuuuguucuuucugucuggccgcggauuaggcaaaaccagcaucgggcuacuguguguaauggcuuccucagugcuccuuuggauggccucugucgagccacauuggauagcagccaguaucauucuggaguucuuuuugauggugcugcucauccccgagccugacaggcagcggacaccccaggauaaccaacuggcuuacguugugauuggacuucucuucaugauccugaccgucgcggccaaugagauggguuugcuggaaacuacgaagaaagacuuaggcauagggcacguagcaguggagaaccaccaucacgcugccaugcuagauguugaccugcauccagccucggcauggacccucuacgcuguggccacaacuauuaucaccccuaugaugcgucacacaauugaaaacaccacugcgaauaucagccuuacagcuauagccaaccaggcagccauccugaugggauuggauaagggcuggcccauuuccaaaauggacaucggugucccacugcucgcucuggggugcuauucucaggugaauccucuuacguuaaccgcagccguccugaugcucguggcgcauuacgcuauuaucggcccgggauugcaagccaaggcaacuagagaggcccagaagaggacagcugccggcauaaugaaaaaccccaccguugaugggauuguggcaaucgaccuggauccaguaguguaugacgcuaaguuugaaaaacagcuaggacagaucaugcugcucauucuuuguaccucacaaauccuguugaugcgcacaacuugggcccugugcgagagcauaacgcucgcgaccggcccucugacaacuuuaugggaggguucccccgggaaguucuggaauaccacaauugccgucaguauggcaaacaucuuccggggaucuuaccuugcuggcgccggucuggcauuuagccucaugaaaucacuaggcgggggacgaagaggcaccggggcucagggagaaacucugggcgagaaguggaagaggcaguugaaucagcuguccaaaagugaguucaacacguauaagcgcagcgguauuauggagguugaccggucugaagccaaagaggggcucaagagaggagagacaaccaaacacgccgugucccguggcacugcgaaacuuaggugguuugucgaacggaaucuggugaagccagaggguaaaguaaucgauuugggcugugggcgcggaggcuggucauacuauugcgcugggcugaagaaagugaccgaaguuaagggauacacaaaaggcgguccugggcacgaggaacccauaccgauggcaacuuacggauggaaccucgugaaguuacauagcggcaaagacgucuucuuugugccaccugagaagugugauacccugcuuugcgacaucggcgagucgucucccaauccaacaauugaagaggggcgaacgcugagaguccuaaagaugguggaacccuggcucaggggaaaccaauucuguaucaaaauucugaauccuuauaugccgaguguuguagagaccuuggagcagaugcagcggaagcacgguggcaugcuggugcgcaacccccucuccagaaauagcacucaugaaauguacugggucucaugcgggacaggaaacaucguguccgccguuaauaugaccucuaggaugcuucugaaccgauuuacuauggcucaccggaaaccaacauaugagcgugauguggacuuaggcgccgguaccagacacgucgcaguggaaccugagguagccaaccuggauauuaucgggcagcgcauagaaaauauuaagcaugagcacaaaagcacguggcauuacgacgaggauaaccccuauaagaccugggcuuaccacggaaguuaugaagugaagccuuccggcagcgcgucuucaaugguuaauggcgucgugaaauugcucacaaagccaugggacgugauccccauggucacucaaaucgccaugaccgauacaacuccuuucgggcagcagaggguuuuuaaagagaagguggacacccggacaccaaaagcaaagagaggaaccgcucaaauuauggaaguaacugccaaguggcugugggguuuccuaagucgcaacaaaaagcccaggauauguacgcgagaggaauuuacacggaaagugagauccaaugcagccaucggcgcugucuucguggacgagaaccaguggaauagcgccaaggaggcgguugaagaugagagguuuugggaccuugugcaucgcgaacgugagcugcacaaacaggggaagugcgcaaccugcgucuacaacaugaugggaaagcgggagaaaaagcucggcgaguucgguaaagccaaggggucuagagcuauuugguacauguggcugggagccagguucuuggaguuugaagcacugggcuucaugaaugaggaucacugguuuucgcgcgaaaacucacucagcggcguggagggggagggacuucauaaacuggguuauaucuuacgagacauuuccaagaucaguggcgggaauauguacgcugaugacacugccggaugggauacccggauaacagaagacgaucugcagaacgaggcuaaaaucacggacauuauggaaccggagcacgccuugcucgcaaagucuaucuucaagcugaccuaucaaaauaaaguaguuagagugcagaggccugcgaagaacggcacugucauggaugugauuagccgcagagaccagcgggguuccggacaggugggaacauacggccuaaauaccuuuacuaacauggaagcccaacuuaucaggcagauggagucagagggcauauucaguccaucugaacuggagacacccaaccucgcugaacgugcccuggauugguuggagaaacauggggucgaacgauuaaagcgcauggcaauuagcggagacgacuguguugugaaaccuaucgaugacagauuugcuaccgcccugacagcacucaaugauauggguaagguacggaaggacaucccacagugggagcccuccaaaggcuggaacgauuggcagcaagugccguucugcucacaccacuuucaucagcuuauuaugaaggacgggagggagauagucgugccuugucgcaaucaggaugaacugguuggcagagcacgggugagccagggcgcggguuggucucuaaaagagacugcuugccuggggaaguccuaugcccaaauguggcagcucauguacuuccacaggcgagacuugcgucuggcagccaacgcuaucuguagugccguccccguggauuggguaccaaccagcagaacgaccuggucgauucaugcacaccaucaguggaugacaacugaagacaugcuuuccguuuggaaucgcguguggaucgaggaaaacccuuggauggaggauaaaacccacauuucuucaugggaggacguccccuaucugggaaagcgggaagaccaauggugcggcagccucaucggcuuaacagcuagggccacuugggcgaccaauauacagguggcuaucaaccagguuagacgccugauugggaaugagaacuacuuggauuacaugacgaguaugaagcgguuuaaaaaugaauccgacccagagggagcccugugguga

SEQ ID NO: 13298 - RNA, 9879 nt, Artificial Sequence
  derived and/or modified CDS sequence (opt3) from DENV-1__FJ639688__SS-prME
uccgugaccaugcugcucaugcuuaugcccacagcacuggcuuuccacuugacuacgagaggaggggaaccucauaugaucgucuccaagcaggaaagaggaaaaucuuuacuguuuaagaccucagccgguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaagaagaugauccgcccucaacccauggaguacaaauauucguggaaaagcuggggcaaggcgaagauaaucggggccgacgugcagaauacuaccuuuauuaucgauggaccaaacacaccugaaugucccgacgaucagagagcuuggaaugucugggagguggaggacuacggcuucgguauuuuuacuaccaacaucuggcuuaaguugagggauuccuauacacagguuugcgaccaccgucucaugucagcagccauaaaagauaguaaggcugugcacgccgacaugggguacuggauugaaucugagaaaaaugaaacguggaagcuggcacgggcgagcuucaucgagguaaagaccuguauuuggccaaaaucccauacucuauggucaaacggaguccuggaaagcgagaugaucauacccaagaucuauggcgguccuauuucucaacacaauuaccgaccaggcuacuucacacagaccgccgggccguggcaucucggaaaacuggagcuugauuuugacuugugcgaaggcacuacagugguggucgaugagcacugcgggaacagaggacccucccugaggaccacgacuguuaccggcaagaucauucacgaaugguguugccgcaguuguacauuaccuccacuccgguucagaggugaggacgggugcugguauggaauggagaucaggcccgugaaagaaaaggaggaaaaucugguaaagagcauggugucugcuggcuccggugaggucgacucauuuagucuuggccuguuguguauaagcauuaugaucgaagaggugaugcgcucgcgauggucccggaaaaugcucaugaccgggacucuggccguuuucuuucuacugaucaugggacagcucacauggaacgaucugauucgucuuugcaucauggugggcgcaaaugcuucugacagaauggggaugggaaccacauacuuggcccugauggcaacuuucaagaugaggccuauguuugccgucggcuuacucuuccgccggcugaccagcagagaggugcuucugcuaacgauuggucucucacugguugcuaguguggaauugccaacaucccuggaggaauuaggggauggacucgcgaugggcauaaugauccugaaacuucugaccgacuuucaaucucaucaguugugggccacucuccugagccuaaccuucauuaagacaacuuuuucccugcacuaugcauggaaaaccauggcuaugguccuuucaaucguaagccuccugcccuugugucugaguacgacaucucagaagaccacuugguuaccggugcuccugggcucccuugggugcaagccucugacaauguucuugauugccgagaacaaaaucuggggaaggcgaagcuggccacucaaugaagguauaauggccguuggcaucgugucgauucugcuaucaucucugcuuaagaacgaugucccccucgcugggccucugaucgcaggaggcauguugauugccuguuacgugaucagugguuccagcgcggacuuaucucuggagaaagcugccgagguaagcugggaagaggaagcagagcauuccggggccucacacaacauacucguggaaguccaggaugacggaaccaugaagauuaaagaugaggagcgcgacgauacucugacaauccuucugaaggcuaccuugcuagcaguuaguggcguguauccccugagcaucccagccacgcucuuugugugguacuucuggcagaagaagaagcagcggucuggcguccugugggacacuccuucacccccagaaguggagagagcgguucuugaugacgggauuuauaggauaaugcagcguggauuacugggucgcagccagguaggcgugggggucuuccaagaaaauguguuucauaccauguggcacguuacacggggagcugugcucauguaccagggcaaaagauuggagccgaguugggccagcgucaagaaagaccugaucuccuacggugggggauggaggcuccagggcucuuggaacaccggcgaggaagugcagguaauugcagucgagccugggaagaaucccaaaaacgugcaaacagccccaggaacuuucaagacccccgaaggugagguuggcgcuaucgcccuggauuuuaagccugggacgucgggaagcccaauugugaaucgagaaggcaaaaucgucggucuuuaugggaacggagugguuacaacuucaggcaccuacguguccgcaauagcucaggccaaggcgagucaggagggcccccugccugagaucgaagacgaggucuuccggaaacgcaauuugacaauuauggaucuacacccggggucuggaaagaccagaagguaucugccagccaucgugcgggaagcaauuaaacgaaagcucagaacuuuaauccuggcucccacccgcguaguggccagcgagauggcugaagcacuuaaggguaugccuauaagguaccaaacaacggccguuaaauccgagcauacuggcaaggagauugucgaccugaugugccacgccaccuuuacaaugcgucucuugucaccagugcgggugcccaacuauaauaugaucaucauggaugaagcucauuucaccgacccuucuagcauugcggcaagaggguacaucaguacuagggucggaaugggcgaggccgcugccauauuuaugacagcaaccccgcccgguuccguagaagccuucccacagagcaacgcugugauucaggaugaggaacgcgacaucccugagcgaucuuggaacucaggguaugaguggauuacggauuuucccggaaaaacuguuugguucgugccauccaucaagaguggcaacgacauagcgaauugucugaggaaaaauggcaagcgggucauucagcucagcaggaagacauuugauaccgaauaccagaaaaccaagaauaacgacugggacuacgugguuacuacagauaucucggagaugggggccaacuuccgcgcagaccgugugaucgauccuagacggugccugaaacccgucauucuuaaggacggaccagaaagggugauccuagcugguccgaugccuguaaccguggccucugcagcccagcgccgaggcagaauugggcggaaucacaacaaagagggagaucaguauauauacaugggccagccccugaauaacgacgaggaucaugcucacuggacagaagccaagauguuguuagacaauaucaacacuccagaggguauuauccccgcgcuguucgaaccugagagggaaaaguccgcagccaucgauggggaguaucgccucagaggcgaggcuaggaaaacguuuguugaacugaugcggcguggagaccuuccagucuggcugagcuacaagguggccucagagggcuuccaauauagugaucgccgauggugcuuugacggggaaagaaauaaccaggugcucgaggaaaauauggaugucgagauuuggaccaaagagggagaaaggaagaaauugcggccccgcuggcuggacgcuagaacauacucugacccucuagcacugagggaguucaaggaauuugccgcuggucggcgauccguuagcggcgaucucauacuugagaucgggaaacugccgcagcacuuaacucagagagcccaaaacgcauuggacaaucuggugaugcuccauaacucagaacagggaggccgcgcguauaggcacgccauggaggagcugccagauaccauugaaacacuuaugcugcucgcuuugaucgccguacugaccgguggggugacuuuauucuuucuaaguggccggggacugggcaagacgagcauugggcuccuuugugucauggcauccucugugcuguuguggauggcuagcguugagccccauuggaucgccgcauccauaauccuggaguucuuucucauggugcugcuuauuccugagcccgaccgucagagaaccccacaggauaaucaacucgccuacgucguaaucggacuguuguucaugauucugacaguggcugcgaacgagauggguuuacuagaaacuaccaagaaagaccugggcaucgggcacguugccgcagagaaucaccaucacgcugccaugcucgauguggaccuucauccugccucagcauggacacuguacgcugucgccaccacuauaauuacacccaugaugaggcacacgaucgaaaacaccacugcgaacauuucuuugacagcuaucgccaaucaggcagccauacugaugggacucgauaagggcuggccaaucaguaaaauggacauuggugugccucugcuugcuuuagggugcuauucgcaggucaacccgcugacccucaccgcagccguguugaugcugguugcgcauuacgcuaucauuggccccggacuacaagccaaggcaacacgcgaggcccagaaacggacugcugccggcaucaugaagaauccaacgguggaugggauaguagcaauugaccuggauccuguggucuaugacgcuaaguuugaaaaacagcucggacagaucaugcuucugaucuuguguaccagccaaauucugcucaugcgaacaacuugggcccugugcgaguccaucaccuuagcgacaggcccccuuaccacucugugggaggguucuccagggaaguucuggaacacgacaauagccguuucaauggcaaauauuuuuagaggaagcuaccucgcuggcgccggucuagcauucucccugaugaaaaguuugggcgggggaaggcgcggcaccggggcucagggagaaacucugggcgagaaguggaaacggcagcucaaccagcuuucuaagagcgaguucaauaccuauaagagaucagguaucauggagguggaccguuccgaagccaaagaggggcugaagaggggagagacaacuaaacacgccgucagucggggcaccgcgaaguugcgcugguuuguggaacgaaaccugguaaaaccugaggguaaggugauugaucucggcugugggagaggaggcuggagcuacuauugcgcuggguuaaagaaaguuacagaagugaagggauacacgaaaggcggucccgggcacgaggaaccgaucccaauggcaaccuacggauggaaucuggucaaacuucauucuggcaaagacguguucuuuauaccucccgagaagugugauacucugcuaugcgacaucggcgaguccucaccaaaccccacaauugaagaggggaggacccuccggguccugaaaaugguggaaccuugguugcgcggaaaucaauucuguaucaagauucugaacccguauaugcccagcguuguagagacucucgagcagaugcagagaaagcacgguggcaugcuugugaggaauccacugucgcgaaacucuacacaugaaauguacugggucaguugcgggaccggaaauaucguguccgccguuaacaugacgagccggauguuacugaaucguuuuaccauggcucacagaaaaccuacauaugagcgcgauguggacuugggcgccgguacuaggcacgucgcaguggaacccgagguagccaaccucgauauuaucgggcagcggauagaaaacauuaagcaugagcacaaaucaaccuggcauuacgacgaggauaauccuuauaagacaugggcuuaccacggauccuaugaagugaaaccaucuggcagcgcgaguuccaugguuaacggcgucgugaagcugcuaacuaagcccugggacgugaucccuauggucacccaaauggccaugacagauaccacuccauucgggcagcagagaguuuuuaaagagaagguggacacgcgcacacccaaagcaaagaggggaaccgcucaaaucauggaaguaacugccaaauggcuuugggguuuccugagccgaaauaagaagccgcggauuuguaccagagaggaauuuacaaggaaagugcgcucuaacgcagccauaggcgcugucuucguggacgagaaucaguggaacucagccaaggaggcgguugaagaugagcguuuuugggaccucgugcaucgggaaagagagcugcacaaacaggggaagugcgcaacgugcgucuacaauaugaugggaaaaagggaaaagaaguugggcgaguucgguaaagccaaggggagucgcgcuaucugguacauguggcugggagcccgauuucucgaguucgaagcacuuggcuucaugaacgaggaucacugguuuucccgggaaaauagccugucuggcguggagggggagggauuacauaaacuggguuauauuuugagagacaucucgaagauuccuggcgggaacauguacgcugaugacaccgccggaugggauacuaggaucacagaagacgaucuccagaaugaggcucgcauaaccgacaucauggaaccagagcacgcccugcuagcaaaaucaauuuucaaacuuacuuaucaaaacaaaguaguuagagugcagcggcccgcgaagaauggcacagucauggaugugaucagcaggcgugaccagcgagguuccgggcaagugggaaccuacggccugaacacauuuacuaauauggaagcccaacucauucgccagauggagagugagggcaucuucucuccuagcgaacuggagaccccaaacuuggcugaaagagucuuagauuggcuggagaaguaugggguugaacggcucaaaaggauggccauauccggagacgacugugugguaaagcccauugaugaccgcuuugcaacggcucuuaccgcccugaacgauauggguaaagugagaaaggacaucccgcagugggagccuucaaaaggcuggaaugauuggcagcaaguccccuucugcagucaucacuuucaccagcuaaucaugaaggacgggcgggagauugugguuccauguaggaaccaggaugaacuggugggacgagcacgugucucucagggcgccgguuggagccucagagagacagcgugcuuggggaaguccuacgcucaaauguggcagcugauguauuuccaucgccgggaccuuaggcuggccgcaaaugccauauguucagcugugccuguagauuggauccccacuagcagaaccacauggucuauucacgcccaucaccaguggaugacuaccgaagacaugcucuccguuuggaaccgcguguggaucgaggaaaauccauggauggaggauaaaacgcauauuaguagcuggggagacguccccuacuuaggcaagcgggaggaccaauggugcggcucgcugaucggguugacagcaagggcuaccugggccacuaacauacagguggcgaucuaccagguucgaagacugauuggaaaugaaaacuaucucgauuacaugacauccaugaaacgguuuaagaaugagucugacccugaaggugcucuuugguga

SEQ ID NO: 13299 - RNA, 9879 nt, Artificial Sequence
  derived and/or modified CDS sequence (opt3) from DENV-1__FJ639689__SS-prME
agcgugaccaugcugcucaugcuuaugcccacugcacuggcuuuccacuugacuaucaggggaggggagccucauaugauugucuccaagcaggaaagggggaaaucuuuacuguuuaagacgucagccgguguuaacaugugcacccuaauagcaauggaccucggagagcugugugaagauaccaugacuuacaaaugcccacggaucaccgaggcggaaccggacgauguggacuguuggugcaaugcuacagauaccugggugacuuaugggacauguagucagaccggagagcaccgccgagacaagcguagcguggcccuugcaccccaugucggccuggguuuggagacgagaacugaaaccuggauguccucugagggggccuggaaacagauucagaggguggaaacaugggcucuccggcacccuggauucacuguuaucgcacuguuucuggcccaugcuauuggcaccucgaucacacagaagggcauaaucuucauucucuuaaugcuggugaccccaucaauggccaugcgcugcgucgggaucggaagccgggauuuuguggagggucuuaguggcgcgacguggguagacguuguguuggagcacggguccugugucacuacaauggcaaaggauaaacccacccuggacauugaacuacucaagacugaggugacaaacccugccauccugaggaaacuuugcauagaagcuaagauuucuaauaccacgaccgauagccgguguccaacacaaggagaggccacucugguggaagaacaggacgcaaacuucgucugccgccgaaccuuuguugauagaggcugggguaauggguguggauuguucggcaaaggcucccucaucacaugcgcuaaguuuaagugcgugacuaaacuggaggggaagauuguacaguacgaaaacuuaaaauauucagugaucgucaccgugcacacaggagaccagcaucaaguugguaaugagaguaccgaacacggcacuacggccacaaucacaccccaggcgccuacuaccgagauucagcugacagacuacggggcccucacccuugauuguagcccaaggacuggacuggacuucaacgaaaugguguugcuaacaaugaaggagaaaucuuggcugguccauaagcagugguuucucgaucugccgcuucccuggacguccggcgcaucaaccagccaagagacuuggaaucggcaggaccuguuggugacauucaaaaccgcucacgccaagaagcaggaaguaguugugcucgguagucaagagggggcuaugcacacagcccugacuggcgcaaccgaaauacagacgucuggaaccacaacuaucuuugccggccauuuaaaaugccgucugaagauggauaaacuaacccucaaggggauguccuaugucauguguacaggcagcuucaaacuggagaaggaaguggcugagacucagcacgguaccguccuugugcagauuaaguacgagggcacggacgcgccuugcaaaaucccauucucgacacaagaugaaaaggggguuacccagaacggacgcuugauaacugcaaaucccauugugacagacaaagagaagccuguaaacaucgaagccgagccacccuuuggcgagucuuauaucgucauuggugcuggggaaaaagcccugaagcucuccugguucaagaaaggcucaaguaucggaaagauguuugaggcaaccgccagaggcgcuaggcggauggccauucugggggauacugcaugggacuucggaagcauagguggcguguuuaccuccguugggaaacuugugcaucagaucuucggaacagcguacggcguccuguuuucuggugugagcuggacgaugaagauugggaucggcguauugcucaccuggcugggauuaaauucacgaaguacuuccuucagcaugacauguaucgcugugggccugguuacccuauaccucggggucauggugcaggccgauucuggaugcgugauuaacuggaaaggccgcgaacugaagugugguucagggauauuugucacaaaugagguucacacuuggaccgaacaauauaaguuccaggcagacaguccgaaaagacuuagcgccgcuaucggaaaggccugggaggagggcgugugcgguauuagguccgcaacgcgguuggaaaacaucauguggaaacagauuucuaacgagcugaaucauauccuccuggaaaacgacaugaaguuuacagugguagucggcgauguggcugggauauuagcccagggcaagaagaugauccgcccucaacccauggaguacaaauauucguggagaagcuggggcaaggcgaagauuaucggggccgacguucagaauaccacuuucauuaucgauggaccaaacaccccugaaugucccgacgaucagagggcuuggaauauaugggagguggaggacuacggcuuugguauuuucacaacuaacaucuggcugaaacuucgugauuccuauacccaggucugcgaccaccgguugaugucagcagccauuaaggauaguaaagcugugcacgccgacaugggguacuggaucgaaucugagaagaaugaaacauggaaacucgcacgagcgagcuucauagagguuaagacguguguguggccaaagucccauacccuguggucaaacggaguacuagaaagcgagaugaucauucccaaaaucuauggcgguccuauuucucaacacaauuacagaccaggcuacuuuacucagacagccgggccguggcaucugggaaagcucgagcuggauuucgaccuuugcgaaggcaccacugucgugguggaugagcacugcgggaacaggggacccuccuugcgcacaaccacggucacuggcaaaaucauacacgaaugguguugccggaguuguacccugccuccauuaagauuuaggggugaggacgggugcugguauggaauggagauucgccccguuaaggaaaaagaggaaaaucucguaaagagcaugguaucugcuggcuccggugagguggacucauucagucugggccuucuguguaucagcaucaugacagaagaggucaugcgaucgcgguggucccguaagauguugaugaccgggacucucgccguguuucugcuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacggugggucucucacugguugcuaguguggaauugccaaacucccuggaggaauuaggggauggacucgcgaugggcauaaugauccugaaacuucugacagacuuucaaccccaucaguugugggccacccuccugucucuaacuuucauuaaaaccacauuuagccugcacuaugcauggaagacuauggcuaugguccuuuccaucguaucacucuucccgcuguguuugagcaccacgagucagaaaacaaccuggcugccuguguuacucggcucucuggggugcaagccacuuacuauguuucugauugccgagaauaagaucuggggacgacgcuccuggcccuugaacgaagguauaauggccguuggcaucgugagcauucuccugucgucacuacugaaaaacgaugucccucuugcugggccccucaucgcaggagugaugcugauugccuguuacguaaucucuggcaguuccgcggacuugagcuuagagaaggcugccgaggugucuugggaagaggaagcagagcauagcggugccucccacaauauacuggucgaaguucaggaugacgggacaaugaaaauuaaggaugaggagcgggacgauacccucacuauccugcuuaaagcuacacuguuggcagugucaggaguguauccacuaaguaucccugccacccuguucgucugguacuucuggcaaaagaaaaagcagagaagcggcgugcucugggacacgcccucuccaccggaaguugagagggcgguacuggaugacggcauuuaucguauaaugcagcgcgggcuuuuaggacggucccaggugggugucggcguguuucaagaaaacguuuuccauacuauguggcacgugaccagaggggcuguccugauguaccagggaaagaggcucgagccuucaugggccagugugaaaaaggacuugaucagcuacggcgguggguggcgacugcagggauccuggaauacaggcgaggaaguacaggucauugcaguggagcccggcaaaaacccaaagaauguucaaaccgcccccgggacauuuaaaacuccugaaggagaggugggugcuaucgcccucgauuucaagccaggcaccucugggucgcccauugucaaccgggaaggaaagaucgugggccuguaugguaaugggguugugacgacaagcggaacuuacgucucagcaauagcucaggccaaagcgucccaggagggcccucuuccggagaucgaagacgagguguuucgcaagagaaaccugaccauuauggauuugcacccaggcagugggaaaacaaggcgguaucuacccgccaucguacgagaagcaauuaagagaaaacugcgcacccucaucuuagcuccuacuagggugguugccucugagauggcugaagcacugaagggaaugccaauacguuaccaaaccacagccgucaagagcgagcauacggguaaagagauuguggaccuuaugugccacgccacuuucaccaugcggcugcucucccccgugagagucccuaauuauaacaugaucaucauggaugaagcucauuuuacagacccgucaucuauugcggcaaggggcuacaucagcacccgcguagggaugggagaggccgcugccauauucaugacugcaacacccccaggcaguguggaagccuuuccucaguccaaugcuguuauucaggaugaggaacgagacauccccgagagaagcuggaacucugguuaugaguggauuaccgauuucccagggaagacggugugguuugucccuucaaucaaauccggaaaugacauagcgaacuguuugcggaagaauggcaaaagggugauucagcugagucgcaagacuuucgauacagaauaccaaaagaccaaaaacaacgacugggacuacguugugaccacugauaucagcgagaugggcgccaauuuccgugcagacagagucaucgauccccggaggugccucaagccagugauucugaaagacgggccggaacgcguaauccuugcuggaccuaugcccgugacaguugccucggcagcccagcgaagaggucggauuggcaggaaccacaauaaggagggggaucaguauauauacaugggacagccacuaaacaaugacgaggaucaugcucacuggaccgaagccaaaaugcuguuggacaacaucaauacacccgagggcauuaucccugcguuauuugaaccagagcgcgaaaagucugcagccaucgauggugaguauagacugagaggggaagcucggaagacuuucgucgaacucaugcgucgcggcgaccugcccguguggcuuuccuacaaaguggccagcgagggauuucaauauucagaucgaagauggugcuucgacggcgaaaggaacaaucagguccuggaggaaaacauggauguugagauuuggacgaaggagggggaacggaaaaagcuccgcccuagaugguuggacgcuaggaccuacagugacccgcuggcacuacgggaguuuaaagaguucgccgcuggacgaagaucuguguccggugaucugauacucgagaucggcaaacuuccacagcaccugacacagcgcgcccaaaaugcauuagacaacuugguaaugcugcauaauagcgaacaaggcgggagggcguaucggcacgccauggaggagcuccccgauacuauugaaacccugaugcuucuggcucucaucgccguguugacagggggugucacccuguuuuucuuaucagggcguggccuaggaaaaacaaguauuggccugcucugugugauggcaagcuccguucuucuguggauggcuucuguggagccucauuggaucgccgcaagcauaaucuuggaauuuuuccugaugguccuccugauucccgagccagacagacagaggacgccucaggauaaccaacuugccuacguagugaucgggcuccuguuuaugauuuugaccguugcugcgaaugagaugggacuguuagaaacaacuaagaaggaccuagguaucggccacguggccgucgggaaccaccaucacgcagcuaugcuggauguggaccuccaucccgccuccgccuggacccuuuacgcagucgcuacaaccauaauuacuccaaugaugcgccacacaaucgagaacacgaccgccaauauuucacugacugcgaucgcuaaccaggccgcaauauugaugggacuggauaaaggcuggccuaucucuaagauggacauuggugugccgcuccuggcccuugggugcuauagucagguuaaucccuuaacacugaccgcugcagugcucauguugguagcccauuacgcgaucauuggcccaggacugcaagcuaaagccacccgggaagcacagaagcgaacagccgcuggcaucaugaaaaacccuacuguggaugggauagucgccauugaccuagaucccguuguguaugacgcaaaguucgagaagcagcugggacagaucaugcuccuuauccuguguacgucgcaaauuuugcugaugagaaccacaugggcucucugcgaaagcaucacucuggccaccggcccauuaacaacccuuugggaggguuccccugggaaauuuuggaauacuacgauagcggucucuauggccaacauuuucaggggaucauaccuggcaggcgcuggucucgccuucagccuaaugaagucccugggcgggggacgccggggcacaggggcacagggagagaccuugggcgaaaaauggaagagacagcugaaucagcucaguaaaucugaguuuaacacuuauaagcguagcgguaucauggaaguggacaggucagaggcuaaggaagggcuuaaacggggagagauuaccaagcacgccguaucccgcggcacagccaaacugcgaugguucguggagagaaauuugguuaagcccgaagguaaagugaucgaucugggcugugggaggggaggcuggaguuacuauugcgcggggcucaagaaggucacugaggugaaaggauacaccaagggcgguccggggcacgaggagccaauaccuauggcuacauacggauggaacuuagucaaacugcauagcggcaaggacguguuuuucguucccccagaaaaaugugauacgcuucugugcgacaucggcgagucuucccccaauccuaccauugaggaagggcggacucuacgcguacucaagaugguggagccguggcugagaggaaaccaauuuuguaucaaaauuuugaaucccuauaugccaucagucguggaaacacuggagcagaugcagaggaagcacgguggcaugcucguucgaaacccucuuagcagaaauucgacccaugagauguacugggugucuugcgggacuggaaacaucgucagugcagugaauaugacaucccguaugcuguuaaacagauucaccauggcccaccgcaagcccacguaugaaagggauguagaccugggcgcugguacccggcacguggccguugagccugaagucgcaaacuuggauauuaucgggcagagaauagagaauauuaaacaugaacacaagagcacauggcauuacgacgaggauaacccauauaaaacuugggccuaccacggaucauaugaggugaagcccuccggcucugcuagcaguauggugaauggcgucguuaaacuccugaccaagccuugggacgugaucccaaugguaacacaaaucgcgaugacugauaccacacccuuugggcagcagcgcguguucaaggaaaaagucgacaccaggacuccgaaggccaaacgaggaacggcacaaauuauggaggugacagcuaaguggcuaugggguuuucuuucccggaacaaaaagccuagaauauguaccagggaagaguucacucgcaagguucguagcaaugccgcaaucggcgccguguuugucgacgaaaaccaguggaacucugcuaaagaggccguggaggaugaacgguucugggaccugguacauagagagagggaacuccacaagcaggggaaaugcgcgaccugcguuuacaacaugaugggaaagcgcgagaaaaagcugggcgaauuugguaaggcaaaagggucacgagccauuugguacaugugguugggagcucgguuccuggaguucgaggcccucggcuuuaugaaugaagaucacugguucaguagagagaacucccuuagcggcguggaaggggagggacugcauaaguuagguuauauccugagggacauuucuaaaaucccaggcgggaauauguacgcagaugacacagcuggaugggauacgcgcauaaccgaggacgauuugcagaacgaagccagaaucacugacauuauggagcccgaacacgcucuccuggccaagucgaucuuuaaacuaacauaucaaaauaaggucgugcgggugcagaggccugccaagaauggcaccgucauggauguuauuucacgucgagaccagcgcgguagcggacaggugggaacuuacggccuuaauacauucaccaacauggaggcgcaacugaucagacagauggaauccgagggcauauuuaguccaucugagcucgaaacacccaaccuggccgagcggguauuggauugguuagaaaaguaugggguggagaggcugaagcgcauggcuauuagcggagacgacugugucgugaaaccgaucgaugacagauucgccacugcacucaccgcucuuaaugauauggguaagguucggaaagacaucccucagugggaacccuccaagggcuggaacgauuggcagcaagugccauuuugcucacaucacuuccaccagcugauuaugaaagacgggagggagauagucgugccuugucgaaaucaggaugagcuaguaggacgugccagaguuagucagggcgcagguuggucucugcgcgaaacggccugccucggaaagagcuacgcgcaaauguggcaguugauguauuuucaucggagggaccugagacuugcugccaacgcaaucuguuccgccgugcccgucgauuggauuccaaccucacgcacaacuuggagcauccacgcucaucaccaguggaugaccacagaggacaugcugucuguguggaaucggguuuggauugaagagaaccccuggauggaagauaagacucauaucuccaguuggggagacgugccuuaccucggcaaaagggaggaccaauggugcggcagcuuaauagggcugaccgcccgagcaacgugggcuacaaauauccaggucgccauuaaccaggugagacgguugaucggaaaugagaacuaccuggauuauaugaccucgaugaagagguucaaaaaugaauccgacccagagggugcgcucugguga

SEQ ID NO: 13300 - RNA, 9879 nt, Artificial Sequence
  derived and/or modified CDS sequence (opt3) from DENV-1__FJ639690__SS-prME
agcgugaccaugcugcucaugcuuaugcccacagcccuggcuuuccacuugacuaucagaggcggggagccucauaugauugucuccaagcaggaaaggggaaaaucuuuacuguuuaagacgucagcagguguuaacaugugcacccuaauagccauggaccucggcgagcugugugaagauacaaugacuuacaaaugcccacggaucaccgaggcggaaccggacgauguggacuguuggugcaaugcuacagauaccuggguaacuuaugggacauguagucaaauuggagagcaccgccgagacaagcguagcguggcccuugcaccccaugucggccuggguuuggagaccagaacggaaacuuggauguccucugagggggccuggaaacagauccagaggguggaaaccugggcucuccggcacccuggauucacaguuauugcacuguuucuggcccaugcuaucggcacuucgauaacccagaagggcaucauuuucauccucuuaaugcuggugacaccaucaauggccaugcgcugcgucgggauuggaagcagagauuuuguggagggucuuaguggcgcgaccuggguagacguuguguuggagcacggguccugugucacgacuauggcaaaggauaaacccacacuggacaucgaacuacucaagaccgaggugacuaacccugccauacugaggaaacuuugcauugaagcuaagaucucuaauacaaccacggauagccgguguccaacccaaggagaggccacacugguggaagagcaggacgcaaacuucgucugccgccgaacuuuuguugauagaggcugggguaauggguguggauuguucggcaaaggcucccucauuaccugcgcuaaguuuaagugcgugacaaaacuggaggggaagaucguacaguacgaaaacuuaaaauauucagugaucgucacugugcacaccggagaccagcaucaaguugguaaugagaguacagaacacggcaccacugccacgauuacaccccaggcgccuaccacugagauacagcugaccgacuacggggcccucacacuugauuguagcccaaggaccggacuggacuucaacgaaaugguguugcuaacuaugaaggagaaaucuuggcugguccauaagcagugguuucucgaucugccgcuucccuggacauccggcgcaucaacgagccaagagaccuggaaucggcaggaccuguuggugacuuucaaaacagcucacgccaagaagcaggaaguaguugugcucgguagucaagagggggcuaugcacaccgcccugacaggcgcaacugaaauccagaccucuggaacgaccacaauuuuugccggccauuuaaaaugccgucugaagauggauaaacuaacucucaaggggauguccuaugucauguguaccggaagcuucaaacuggagaaggaaguggcugagacacagcacgguacuguccuugugcagaucaaguacgagggcaccgacgcgccuugcaaaauaccauucucgacgcaagaugaaaaggggguuacacagaacggacgcuugauuaccgcaaaucccaucgugacugacaaagagaagccuguaaacaucgaagccgagccacccuuuggcgagucuuauauugucaucggugcuggggaaaaagcccugaagcucuccugguucaagaaaggcucaaguauuggaaagauguuugaggcaacagccagaggcgcuaggcggauggccauacugggggauaccgcaugggacuucggaagcaucgguggcguguuuacuuccguugggaaacuugugcaucagauuuucggaaccgcguacggcguccuguuuucuggugugagcuggacaaugaagaucgggaucggcguauugcucacguggcugggauuaaauucacgaaguaccuccuucagcaugacuuguauugcugugggccugguuacacuauaccucggggucauggugcaggccgauucuggaugcgugauaaacuggaaaggccgcgaacugaagugugguucagggaucuuugucaccaaugagguucacacauggacugaacaauauaaguuccaggcagacaguccgaaaagacuuagcgccgcuauuggaaaggccugggaggagggcgugugcgguaucagguccgcaacccgguuggaaaacauuauguggaaacagaucucuaacgagcugaaucauauacuccuggaaaacgacaugaaguuuacggugguagucggcgauguggcugggaucuuagcccagggaaaaaagaugauucgcccucaacccauggaguacaaauauucguggagaagcuggggcaaggcgaagaucauuggggccgacguucagaauacaaccuucaucauagauggaccaaacacuccugaaugucccgacgaucagagggcuuggaauauuugggagguggaggacuacggcuuugguaucuucaccacaaacauuuggcugaaacuucgugauuccuauacucaggucugcgaccaccgguugaugucagcagccaucaaggauaguaaagcugugcacgccgacaugggguacuggauagaaucugagaagaaugaaaccuggaaacucgcacgagcgagcuucaucgagguuaagacauguguguggccaaagucccauacgcuguggucaaacggaguacuagaaagcgagaugauuauccccaaaauuuauggcgguccuaucucucaacacaauuacagaccaggcuacuuuacccagacugccgggccguggcaucugggaaagcucgagcuggauuucgaccuuugcgaaggcacaaccgucgugguggaugagcacugcgggaacaggggacccuccuugcgcacuacaaccgucacgggcaaaauaauucacgaaugguguugccggaguuguacucugccuccauuaagauuuaggggugaggacgggugcugguauggaauggagauccgccccguuaaggaaaaagaggaaaaucucgugaagagcaugguaucugcuggcuccggugagguggacucauucagucugggccuucuguguaucagcauuaugaccgaagaggucaugcgaucgcgguggucccguaagauguugaugacagggacccucgccguguuucugcuacugaucaugggacagcucacuuggaacgaucugauuagacuuugcauaaugguuggcgcaaaugcuucugacaggauggggaugggaacaaccuacuuggcccugauggcaacauucaaaaugcgcccuauguuugccgugggcuuacucuuccggagacugacuagcagggagguccuucugcuaaccgugggucucucacugguugcuaguguggaauugccaaacucccuggaggaauuaggggauggacucgcgaugggcaucaugauucugaagcuucugacggacuuucaaccccaucaguugugggccacacuccugucucuaaccuucaucaaaacuaccuuuagccugcacuaugcauggaagacaauggcuaugguccuuuccauuguaucacucuucccgcuguguuugagcacuaccagucagaaaacgacauggcugccuguguuacucggcucucuggggugcaagccacuuaccauguuucugaucgccgagaauaagauauggggacgacgcuccuggcccuugaacgaagguaucauggccguuggcauugugagcauccuccugucgucacuacugaaaaacgaugucccucuugcugggccccucauugcaggaggcaugcugaucgccuguuacgugauaucugguaguuccgcggacuugagcuuagagaaggcugccgagguaucuugggaagaggaagcagagcauagcggggccucccacaauauucugguggaaguccaggaugacggaacuaugaaaaucaaggaugaggagcgggacgauacacucaccauccugcuuaaagcuacucuguuggcaguuucaggcguguauccacuaaguauuccugccacacuguucgugugguacuucuggcaaaagaaaaagcagagaagcggcguccucugggacacccccucuccaccggaaguggagagggcgguucuggaugacgggauauaucguaucaugcagcgcggacuuuuaggucggucccagguaggcgugggggucuuucaagaaaacguguuccauacgauguggcacguuacuagaggagcugugcugauguaccagggcaagaggcucgagccuucaugggccagugucaaaaaggacuugauuagcuacggugggggauggcgacugcagggcuccuggaauaccggcgaggaagugcagguaaucgcagucgagcccgggaaaaacccaaagaaugugcaaacagcccccggaaccuuuaaaacaccugaaggugagguuggcgcuauugcccucgauuucaagccagggacuucuggaucgcccaucgugaaccgggaaggcaagauagucggucuguaugggaauggagugguuaccacgagcggcacauacgugucagcaaucgcucaggccaaagcgucccaggagggcccucuuccggagauugaagacgaggucuuucgcaagagaaaccugacuaucauggauuugcacccagggaguggaaaaaccaggcgguaucuacccgccauugugcgagaagcaaucaagagaaaacugcgcacacucauauuagcuccuaccaggguaguggccucugagauggcugaagcacugaaggguaugccaauucguuaccaaacuaccgccguuaagagcgagcauacaggcaaagagaucgucgaccuuaugugccacgccacguucacuaugcggcugcucucccccgugagagugccuaauuauaacaugaucauuauggaugaagcucauuuuaccgacccgucaucuaucgcggcaaggggguacauaagcacacgcgucggaaugggcgaggccgcugccauuuucaugaccgcaacucccccagguaguguagaagccuuuccucaguccaaugcugugauccaggaugaggaacgagacauucccgagagaagcuggaacucuggguaugaguggaucacagauuucccaggaaagaccguuugguuugugccuucaauaaaauccggcaaugacauugcgaacuguuugcggaagaauggcaaaagggucauccagcugagucgcaagacguucgauacugaauaccaaaagacaaaaaacaacgacugggacuacgugguuaccaccgauaucagcgagaugggggccaauuuccgugcagacagagugauugauccccggaggugccucaagccagucauccugaaagacggaccggaacgcgugauucuugcugguccuaugcccguaacuguggccucggcagcccagcgaagaggccggauagggaggaaccacaauaaggagggagaucaguauaucuacaugggccagccacuaaacaaugacgaggaucaugcucacuggacagaagccaaaaugcuguuggacaacauuaauacccccgaggguaucaucccugcguuauuugaaccagagcgcgaaaagucugcagccauugauggggaguauagacugaggggcgaggcucggaagacauucguugaacucaugcgucgcggagaccugcccgucuggcuuuccuacaaaguggccagcgagggcuuucaauauucagaucgaagauggugcuucgacggggaaaggaacaaucaggugcuggaggaaaacauggaugucgagauauggacuaaggagggagaacggaaaaagcuccgcccuagaugguuggacgcuaggacguacagugacccgcuggcacuacgggaguuuaaagaauucgccgcuggucgaagaucuguuuccggcgaucugauccucgagauugggaagcuuccacagcaccugacccagcgcgcccaaaaugcauuagacaacuuggugaugcugcauaauagcgaacagggaggcagggcguaucggcacgccauggaggagcuccccgauacaaucgaaacucugaugcuucuggcucucauugccguauugaccgguggggugacacuguuuuucuuaucaggccguggacuaggcaaaaccaguaucgggcugcucugugucauggcaagcuccgugcuucuguggauggcuucuguugagccucauuggauagccgcaagcaucauuuuggaauuuuuccugauggugcuccugauccccgagccagacagacagaggacuccucaggauaaccaacuugccuacgucguaauuggacuccuguuuaugaucuugacgguggcugcgaaugagaugggucuguuagaaaccacaaagaaggaccuaggcauagggcacguugccgugggaaaccaccaucacgcagcuaugcuggaugucgaccuccaucccgccuccgccuggacucuuuacgcaguggcuaccacaauuaucaccccaaugaugcgccacacuauugagaacacaacggccaauaucucacugaccgcgauagcuaaccaggccgcaaucuugaugggccuggauaaagguuggccuauuucuaagauggacaucggggucccgcuccuggcccuuggcugcuauagucaggugaaucccuuaacucugacagcugcaguucucauguugguggcccauuacgcgauuaucggaccaggccugcaagcuaaagccacccgggaagcacagaagcgaaccgccgcugggauaaugaaaaacccuacaguagauggaauuguggccaucgaccuagaucccgucguuuaugacgcaaaguucgagaagcagcugggccagaucaugcuccuuauucuguguacuucgcaaaucuugcugaugagaacgaccugggcucucugcgaaagcauaacacuggccacugguccauuaaccacacuuugggagggguccccuggaaaauuuuggaauaccacuauugcggugucuauggccaacaucuucaggggcucauaccuggcaggugcuggccucgccuucagccuaaugaagucccuggggggaggccgccgggggacgggagcacagggcgagacauugggugaaaaauggaagagacagcugaaucagcucaguaaaucugaguuuaacaccuauaagcguagcgggauuauggaagucgacaggucagaggcuaaggaaggacuuaaacggggcgagaucacuaagcacgccgugucccgcgguaccgccaaacugcgaugguucguagagagaaauuuggugaagcccgaaggcaaaguuauagaucugggguguggaaggggcggguggaguuacuauugcgcgggacucaagaaggugacagaggucaaaggcuacacuaagggugggccgggacacgaagagccaaucccuauggcuaccuacggcuggaacuuagugaaacugcauagcggcaaggacgucuuuuucgugcccccagaaaaaugugauacacuucugugcgacauuggggagucuucccccaauccuacgaucgaggaaggacggacccuacgcguucucaagaugguagagccguggcugagagguaaccaauuuuguauuaaaaucuugaaucccuauaugccaucaguggucgaaacucuggagcagaugcagaggaagcacggcgggaugcucgugcgaaacccucuuagccggaauucgacacaugagauguacuggguuucuugcggaaccggcaacauugugagugcagucaauaugacuucccguaugcuguuaaacagauucacaauggcccaccgcaagcccaccuaugaaagggauguggaccugggugcugggacgcggcacguagccguggagccugaaguugcaaacuuggauaucauaggacagagaauugagaauaucaaacaugaacacaagagcaccuggcauuacgacgaggauaacccauauaaaacaugggccuaccacggcucauaugaggucaagcccuccggcucugcuagcaguauggugaaugggguggucaaacuccugacuaagccuugggacguuaucccaauggugacccaaauugcgaugacagauacuacccccuuuggacagcagcgcguauucaaggaaaaaguggacacaaggaccccgaaggccaaacgagguacugcacaaauaauggaggucacggcuaaguggcuauggggcuuucuuucccggaacaaaaagccuagaaucuguacaagggaagaguucacccgcaaggugcguagcaaugccgcaauuggggccguuuuuguggacgaaaaccaguggaauucugcuaaagaggccgucgaggaugaacgguucugggaccuggugcauagagagagggaacuccacaagcagggaaaaugcgcgacuugcguauacaacaugaugggcaagcgcgagaaaaagcugggugaauuugggaaggcaaaaggaucacgagccaucugguacaugugguugggcgcucgguuccuggaguucgaggcccucggcuuuaugaaugaagaucacugguucaguagagagaacucccuuagcgggguugaaggagagggucugcauaaguuaggcuauauucugagggacaucucuaaaauaccagggggaaauauguacgcagaugacaccgcuggcugggauacacgcaucacggaggacgauuugcagaacgaagccagaauuaccgacaucauggagcccgaacacgcucuccuggccaagucgauuuuuaaacuaacuuaucaaaauaaggugguccgggugcagaggccugcaaaaaacgguacagugauggaugucaucucacgucgagaccagcgcgggagcggacagguuggcaccuacggccuuaauacuuucacaaacauggaggcgcaacugauaagacagauggaauccgaggggauuuuuaguccaucugagcucgaaacccccaaccuggccgagcggguguuggauugguuagaaaaguauggaguagagaggcugaagcgcauggcuaucagcggugacgacuguguggucaaaccgaucgaugacagauucgccacagcacucacugcucuuaaugauaugggcaaggugcggaaagacauuccucagugggaacccuccaagggguggaacgauuggcagcaaguuccauuuugcucacaucacuuccaccagcugauaaugaaagacggaagggagaucguggucccuugucgaaaucaggaugagcuagugggccgugccagaguaagucagggugcaggguggucucugcgcgaaaccgccugccucggaaagagcuacgcgcaaauguggcaguugauguauuuucaucggagggaccugagacuugcugccaacgcaauuuguuccgccguucccguggauuggaucccaacgucacgcaccacauggagcauucacgcucaucaccaguggaugacuaccgaggacaugcugucugucuggaaucggguguggaucgaagagaaccccuggauggaagauaagacacauauauccaguuggggcgacguuccuuaccucggcaaaagggaggaccaauggugcgggagcuuaaucggacugacugcccgagcaaccugggcuacgaauauucagguggccaucaaccaggucagacgguugauugguaaugagaacuaccuggauuauaugacaucgaugaagagguucaaaaaugaauccgacccagagggcgcgcucugguga

SEQ ID NO: 13301 - RNA, 9879 nt, Artificial Sequence
  derived and/or modified CDS sequence (opt3) from DENV-1__FJ639691__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaacaugugcacacugauugccauggaccucggagaguucugugaagauacuaugaccuacaaaugcccacggauaagugaagcggaaccggacgauguggacuguuggugcaaugcuacagauaccuggguaacuuaugggacauguagccaaaccggagagcaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuuacugacuuccaauccuaucagcugugggccaccuugcucucacugacguuuaucaaaacaaccuucagccuacauuacgcauggaagacuauggcuauggugcugaguauugucucucuuuuuccccucugucuguccaccacaagccagaagacuaccugguugccgguacuguuaggcucgcucgggugcaaaccucugacgauguuccuuaucgccgagaauaagauauggggaagaaaaucauggccacugaacgaagguaucauggccgugggcauuguuucuaucuugcucaguucccugcuaaagaacgaugugccccuggcugggccucuuauugcaggaggcaugcucaucgccuguuaugucauaagcgguucuagcgcggaccuguccuuggagaaagcugccgaggugucaugggaagaggaagcagagcacaguggggccagccauaauauuuuaguagaagugcaggaugacggaacaaugaagaucaaagaugaggagagggacgauacccugacuauccuccugaaggcuacacuucuggcagucucuggcguuuaccccuuguccauuccagccacccuauucgugugguauuuuuggcaaaagaaaaagcagcgaucaggcgugcugugggacacuccuagucccccagaagucgagcgcgcggugcucgaugacgggauauaccggaucaugcagagaggacugcuugguaggagccagguuggcguagggguguuccaagaaaacgucuuucacacaauguggcaugugacccguggagcuguuuuaauguaccagggcaaacgccuggagccguccugggccucugugaagaaagaccucauuucguauggugggggauggcgguugcagggcagcuggaauacgggcgaggaaguccaggugaucgcaguagagccugggaagaaccccaagaauguccaaacugccccaggaaccuucaaaacaucagaaggugaggugggcgcuauugcccuggauuuuaagcccgggaccuccggaaguccuaucguuaacagagaaggcaaaauagugggucucuacgggaauggagucgugacaacuucuggcaccuauguuagcgcaaucgcucaggccaaggcgucccaggagggcccacugcccgagauugaagacgagguguucaggaaacgaaaccuuacgaucauggaucugcacccugggucaggaaagacacggcgcuacuugccggccauugucagagaagcaaucaagaggaaacuacggacucugauacucgcuccaacccgagugguagccucugagauggcugaagcauuaaaggguaugcccauuagauaucaaacaaccgccgugaaaagcgagcacacuggcaaggagaucguugaccugaugugccaugccaccuuuacaaugcgccuucugaguccugucagggugccaaauuacaacaugaucauuauggaugaagcucacuucacggaccccuccagcaucgcggcacguggguauauaucuacucgggugggaaugggcgaggccgcugccauuuuuaugaccgcaacaccuccggguucagucgaagccuucccccaguccaaugcuguaauccaggaugaggaaagagacauuccagagaggaguuggaacagcggguacgaguggaucaccgauuuuccuggaaaaacugugugguucguucccucgauaaagucuggcaaugacauugcgaacugucuccgcaagaauggcaaacgagugauccaguuguccagaaagacauucgauaccgaauaccagaagacgaagaacaacgacugggacuaugucgugacuacagauaucagcgagaugggggccaauuuucgggcagacaggguuauugauccacgccguugccugaaaccugugauccucaaggacggacccgaaagagucauucuggcugguccaaugccggugaccguagccucagcagcccagcggaggggccgcauagggcgaaaccauaauaaggagggagaucaguacaucuauaugggccagccucuuaacaaugacgaggaucacgcucauuggaccgaagccaaaaugcuacuggacaacauuaauacucccgaggguaucaucccagcguuguucgaacccgagagagaaaagagugcagccauugauggggaguaccgguuaaggggcgaggcucgcaaaacauuuguggaacugaugagaaggggagaccucccuguuuggcugucuuauaaggucgccuccgagggcuuccaauacagcgaucggcguuggugcuuugacggggaacgcaacaaucaggugcuugaggaaaacauggauguggagauauggaccaaagagggagaacgaaagaaacugagaccaagguggcucgacgcucggacauauucagaccccuuggcacugcgcgaguucaaggaauuugccgcugguagaaggagugucagcggcgaucuaauccuggagauugggaagcucccucagcaccuuacucagcgggcccaaaaugcacuggacaacuuaguuauguugcacaauuccgaacagggaggccgagcguacagacaugccauggaggagcugccggauacgaucgaaacccucaugcugcuugcucugauugccgugcucacaggugggguaacuuuguucuuucugucuggccgcggauuaggcaaaaccagcaucgggcuacugugugugauggcauccucaguccuccuuuggauggcuucuguggagccacacuggauagccgcaaguaucauucuggaguucuuuuugaugguucugcucauccccgagccugacaggcagcggacaccccaggauaaccaacuggccuacguggucauuggacuucucuucaugauccugaccguagcugcgaaugagauggguuugcuggaaacuacgaagaaagacuuaggcauagggcauguggccguugagaaccaccaccaugcagcuaugcuagauguggaccugcacccagccucggccuggacccucuaugcagucgcuacaacuauuaucaccccuaugaugcgucauacaauugaaaacaccacugccaauaucagccuuacagcgauagcuaaccaggccgcaauccugaugggauuggauaagggcuggcccauuuccaaaauggacaucggugugccacugcucgcccuggggugcuacucucaggucaauccucuuacguuaaccgcugcagugcugaugcucguugcccacuaugcgauuaucggcccgggauugcaagcuaaggccacuagagaggcacagaagaggacagccgcuggcauaaugaaaaaccccaccguggaugggauuguagccaucgaccuggauccaguggucuacgacgcaaaguuugaaaaacagcuaggacagaucaugcugcucauucuuuguaccucacaaauccuguugaugcgcacaacuugggcucugugcgagagcauaacgcucgccaccggcccucugacaacuuuaugggaggguucccccgggaaguucuggaauaccacaauugcgguuaguauggccaacaucuuccggggaucuuaucuugcaggcgcuggucuggccuuuagccucaugaaaucacuaggcgggggacgaagaggcaccggggcacagggagaaacucugggcgagaaguggaagaggcaguugaaucagcuguccaaaagugaguucaacacguacaagcgcagcgguauuauggagguggaccggucugaagcuaaagaggggcucaagagaggagagacaaccaaacaugccgucucccguggcacugccaaacuuaggugguuuguggaacggaaucugguaaagccagaggguaaagugaucgauuugggcugugggcgcggaggcuggucauauuacugcgcggggcugaagaaaguuaccgaagugaagggauacacaaaaggcgguccugggcacgaggaacccauaccgauggcuacuuauggauggaaccucgucaaguuacacagcggcaaagacguguucuuugucccaccugagaagugugauacccugcuuugcgacaucggcgagucgucucccaauccaacaauugaagaggggcgaacgcugagagugcuaaagaugguugaacccuggcucaggggaaaccaauucuguaucaaaauucugaauccuuacaugccgaguguaguggagaccuuggagcagaugcagcggaagcaugguggcaugcugguccgcaacccccucuccagaaauagcacucacgaaauguauugggugucaugcgggacaggaaacaucguuuccgcagugaauaugaccucuaggaugcuucugaaccgauuuacuauggcccaucggaaaccaacauacgagcgugaugucgacuuaggcgcugguaccagacacguggccguagaaccugagguggcaaaccuggauauuaucgggcagcgcauagaaaauauuaagcacgagcauaaaagcacguggcacuaugacgaggauaaccccuacaagaccugggccuaucauggaaguuacgaaguuaagccuuccggcagcgcuucuucaauggucaauggcguggugaaauugcucacaaagccaugggacgucauccccaugguuacucaaaucgcgaugaccgauacaacuccuuucgggcagcagaggguguuuaaagagaagguagacacccggacaccaaaagccaagagaggaaccgcacaaauuauggaagugacugcuaaguggcugugggguuuccuaagucgcaacaaaaagcccaggauauguacgcgagaggaauuuacacggaaagucagauccaaugccgcaaucggcgccguguucguugacgagaaccaguggaauagcgcuaaggaggccguggaagaugagagguuuugggaccuuguccaccgcgaacgugagcugcauaaacaggggaagugcgcgaccugcguguacaacaugaugggaaagcgggagaaaaagcucggcgaguucgguaaagcaaaggggucuagagccauuugguauauguggcugggagcuagguucuuggaguuugaagcccugggcuucaugaaugaggaucacugguuuucgcgcgaaaacucacucagcggcguagagggggagggacuucacaaacuggguuacaucuuacgagacauuuccaagaucaguggcgggaauauguaugcagaugacacugcuggaugggauacccggauaacagaagacgaucugcagaacgaggccaaaaucacggacauuauggaaccggagcaugcuuugcucgccaagucuaucuucaagcugaccuaccaaaauaaaguugugagaguccagaggccugcaaagaacggcacugugauggaugugauuagccgcagagaccagcgggguuccgggcaggucggaacauauggccuaaauaccuuuacuaacauggaagcgcaacuuaucaggcagauggagucagagggcauauucaguccaucugaacuggagacacccaaccucgccgaacguacccuggauugguuggagaaacacgggguugaacgauuaaagcgcauggcuauuagcggagacgacugugugguaaaaccuaucgaugacagauuugccacagcacugacugcucucaaugauauggguaaggugcggaaggacaucccacagugggagcccuccaaaggcuggaacgauuggcagcaagucccguucugcucacaucacuuucaccagcuuauuaugaaggacgggagggagauagugguuccuugucgcaaucaggaugaacuggugggcagagcacgggucagccagggcgcagguuggucucuaagggagaccgccugccuggggaaauccuacgcgcaaauguggcagcucauguauuuccaucgacgugacuugagacuggcugccaacgcaaucuguagugccgugcccguagauuggguuccaacgagccgcaccacauggucgauucacgcucaucaccaguggaugacuaccgaagacaugcuuuccguguggaaucgggucuggaucgaggaaaacccuuggauggaggauaagacacauauuucuucaugggaggacgugcccuaccugggaaaaagggaagaccaauggugcggcagccucaucggcuuaacugccagagcaaccugggcuacgaauauacagguugccaucaaccaggugcgccggcugauugggaaugagaacuacuuggauuauaugacaaguaugaagagguuuaagaaugaauccgaccuggagggagcgcucugguga

SEQ ID NO: 13302 - RNA, 9879 nt, Artificial Sequence
  derived and/or modified CDS sequence (opt3) from DENV-1__FJ639692__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagucggccuggaaacagauccagaggguggaaacuugggcucuccggcacccuggguucaccguuauugcacuguuucuggcccaugcuaucggaacaucaauuacccagaagggcaucauauucauccucuuaaugcuggugacgccaagcauggccaugcgcugcgucggcauugggaguagagauuuuguggagggacuuuccggugcgacuuggguagacguuguguuggagcacggcucuugugucacaaccauggcaaaggauaaacccacucuggacaucgaacuacucaagacagaggugaccaacccugccauucugaggaaacuuugcaucgaagcuaagauaagcaauacgaccacagauucccgguguccaacucaaggggaggccacccugguggaagagcaggacgcaaacuucgucugccgccgaacauuuguugauagaggauggggcaaugguuguggguuguucggaaaaggcucacucauuacuugcgcuaaguuuaagugcgugaccaaacuggagggcaagaucguacaguacgaaaacuuaaaauauagugugauugucacagugcacaccggggaccagcaucaaguuggaaaugagagcacugaacacgguacgacagccaccaucacuccccaggcgccuaccacagagauccagcugaccgacuacggcgcccucacucuugauuguucuccaaggacagggcuggacuucaacgaaaugguguugcuaacgaugaaggagaaauccuggcugguccauaagcagugguuucucgaucugccgcuucccuggaccucaggagcaagcacuagucaagagacauggaaucggcaggaccuguuggugaccuucaaaacagcucacgccaagaagcaggaaguaguugugcucggcucucaagagggugcuaugcacacugcccugaccggggcaacggaaauucagaccuccggcacaacuaccauauuugccggacauuuaaaaugccgucugaagauggauaaacuaacacucaagggcaugagcuaugucauguguacugggucguucaaacuggagaaggaaguggcugagacccagcacggaacgguccuugugcagaucaaguacgaggguacagacgcgccuugcaaaauuccauucucuacccaagaugaaaagggcguuacucagaacgggcgcuugaucacagcaaaucccauagugaccgacaaagagaagccuguaaacauugaagccgagccacccuuuggagaguccuauaucgucaucggcgcuggugaaaaagcccugaagcucucaugguucaagaaagggaguagcauuggcaagauguuugaggcaacugccagaggagcuaggcggauggccauccugggcgauaccgcaugggacuucggguccauuggagguguguuuacaucuguuggcaaacuugugcaucagauauucgggacggcguacggaguccuguuuagcggcgugucauggaccaugaagaucgguauugggguauugcucacuuggcugggcuuaaauagucgauccacaagccugucuaugaccuguaucgcugugggacuaguuacacucuaccugggcgucauggugcaggccgauucagggugcgugaucaacuggaaaggacgcgaacuuaaguguggcagugguauuuucgucacuaaugagguucacaccuggacggaacaauauaaguuucaggcagacagcccgaaaagauuguccgccgcuauagggaaggccugggaggagggagugugcggcaucaggucugcaacacggcuggaaaacauuauguggaaacagaucucgaacgagcucaaucauauucuguuagaaaacgacaugaaguucaccgugguagucggugauguggcuggcauccuggcccaggggaaaaagaugauacgcccucaacccauggaguacaaauauagcuggaaguccuggggaaaggcgaaaaucauuggcgccgacguucagaauacuaccuuuaucauugaugggccaaacacaccugaaugucccgacgaucagagagcuuggaauaucugggagguggaggacuacggauucggcauauuuacuaccaacauuuggcuuaaguugagggauucauauacacaggucugcgaccaccgucucaugagugcagccaucaaagauucuaaggcugugcacgccgacauggguuacuggauugaaagcgagaaaaaugaaacguggaagcuggcacgggcguccuucaucgagguuaagaccuguauauggccaaaaucacauacucuauggagcaacggggugcuggaaucugagaugaucauucccaagaucuauggaggcccuauuucccaacacaauuaccgaccagguuacuucacacagaccgccggcccguggcaucucgggaaacuggagcuugauuuugacuugugcgaaggaacuacaguagucguggaugagcacugcggcaacagagggcccagucugaggaccacgacugugaccggaaagaucauacacgaaugguguugccgcagcuguacauuaccuccacuccgguucagaggcgaggacgguugcugguaugggauggagauuaggcccgucaaagaaaaggaggaaaaucugguuaagucuaugguguccgcuggaucaggcgagguagacaguuuuagccuuggucuguuguguaucucgaucaugauugaagaggugaugcgcucccgauggucucggaaaaugcucaugaccggcacucuggccgucuuccuacugcucaucauggggcagcugacauggaacgaucuuauucguuugugcauaauggugggagcaaaugcuagcgacagaaugggcauggggaccacauaccuggccuuaauggcaacuuuuaagaugaggccuauguucgccguuggacuccuguuucgccggcuuaccucaagagaggugcugcuacucacgaucggccugaguuuggucgcuuccguggaacugccaaacucuuuagaggaacucggugaugggcuggcgaugggaauuaugauccuuaaacuguugacagacuuccaaagccaucagcucugggccacccugcuaucccugacuuuuauuaagaccacauucucacuucacuaugcauggaaaacuauggcuaugguucucagcaucgugagucuguuucccuugugucugucuaccacgucccagaagacaaccugguuaccgguccuccugggcagccuuggcugcaagccucugacuauguucuugauagccgagaauaaaaucugggggaggcgaucguggccacucaacgaaggaauuauggccguagguaucgugucaauucugcuaucuagucugcuuaagaacgauguuccccucgcuggcccucugaucgcagggggaauguugauagccuguuacgugauuuccggcagcucugcggacuuaagccuggagaaagcugccgaggucuccugggaagaggaagcagagcauucaggugccagucacaauauccucguggaaguacaggaugacgggacaaugaagaucaaagaugaggagcgcgacgauacccugacuauucuucugaaggcuacauugcuagcagugagcggagucuauccccugucuauaccagccacccucuuuguuugguacuucuggcaaaaaaagaagcagcgguccggcgugcugugggacacgccuucacccccagaaguggagagagcgguccuugaugacggcaucuauaggauuaugcagcguggguuacugggacgcagucagguggguguuggcguauuccaagaaaacguguuucauacuauguggcacgucacccggggggcugugcucauguaccagggaaaaagauuggagccgagcugggccuccguuaagaaagaccugaucucuuacggcgguggguggaggcuccagggaucguggaauacaggcgaggaagugcaggucauugcaguggagccuggcaagaaccccaaaaauguacaaaccgccccagggacauucaagacucccgaaggagaggucggugcuaucgcccuggauuuuaagccuggcaccagcgggucaccaauagugaaccgagaaggaaaaaucguuggccuuuaugguaaugggguggucacgacauccggaacuuacgugagugcaauugcucaggccaaggcgucucaggagggcccccugccugagaucgaagacgagguuuuccggaaacgcaacuugaccauuauggaucuacacccgggcagcgggaagacaagaagguaucugccagccaucgugcgggaagcaauaaaacgaaagcucagaaccuuaauucuggcucccacucgcgucguggccuccgagauggcugaagcacuuaagggaaugccuaucagguaccaaaccacagccguaaaaucagagcauacggguaaggagaucguggaccugaugugccacgccacuuuuaccaugcgucucuugucuccaguucggguccccaauuauaacaugauuaucauggaugaagcucauuucacagacccuagcaguauagcggcaagaggcuacauuuccaccaggguggggaugggagaggccgcugccaucuuuaugacugcaacaccgcccggcagcguggaagccuucccacagucuaaugcucugauucaggaugaggaacgcgacaucccugagcgaucauggaacuccgguuaugaguggauaaccgauuuucccgggaaaacggucugguucguaccaaguauuaagagcggaaaugacaucgcgaacugucucagaaaaaauggcaagcgggugauccagcugucgaggaagacuuuugauacagaauaccaaaaaaccaagaacaacgacugggacuacguugugaccacugauauuucugagaugggcgccaauuuccgcgcagaccgugucaucgauccuagacggugccuuaaacccgugauucuaaaggacgggccagaaaggguuauacuggcuggaccgaugccugugacagucgccuccgcagcccagcgccgagguagaaucggccggaaccacaauaaagagggggaucaguauauuuacaugggacagcccuugaacaaugacgaggaucaugcucacuggaccgaagccaagauguuacuggacaacaucaauacaccagagggcaucauucccgcgcucuucgaaccugagagggaaaagagcgcagccauagauggugaguaucgccugagaggggaggcuaggaaaacuuuuguggaacuuaugcggcguggcgaccugccaguauggcucucauacaagguggccagugagggauuccaauauucugaucgccgauggugcuuugacggcgaaagaaacaaucagguuuuggaggaaaacauggaugucgagaucuggacgaaagagggggaaaggaagaaacugcggccccgcuggcuagacgcuagaaccuacuccgacccucuggcacucagggaguucaaggaauuugccgcuggacggcgaagcgugucaggugaucuuauucuggagaucggcaaauuaccgcagcacuugacacagagagcccaaaaugcacuggacaaccucgugaugcugcauaauagugaacaggggggacgcgcguauaggcacgccauggaggagcuuccagauacuauugaaacccugaugcucuuggcucugaucgccgucuuaacaggcgguguuacccuauucuuucugagcgggcggggccucggaaagacuuccauaggccuucugugugugauggcaucuagcguauugcuguggauggcuuccguggagccccauuggaucgccgcaucaauuauccucgaauucuuucugaugguccuucucauuccugagcccgaccgucagagaacgccacaggauaaccaacuggccuacgugguuaucggguugcuguucaugauauuaaccguggcugcgaaugagaugggacuacuggaaacaacuaagaaagaccucgguauuggccacgucgccguagggaaccaccaucacgcagcuaugcuugauguggaccugcauccugccucugccuggaccuuguacgcaguugcuacaaccaucauuacucccaugaugaggcacacaaucgagaacacgaccgccaauauaagucugacugcgaucgcuaaccaggccgcaauucucaugggacuggauaagggcuggccaaucucgaaaauggacauuggugugccucuuuuagcccuggggugcuauagccaggucaauccgcucacauugaccgcugcagugcugaugcuagucgcccauuacgcgaucauaggccccggacugcaagcuaaggccacccgcgaagcacagaaacggacagccgcuggcauuaugaagaacccaacuguggaugggaucguugccaucgaccucgauccugugguauaugacgcaaaguuugagaaacagcuuggacagauuaugcuguugauccuguguacgucccaaauacuccugaugcgaaccacaugggcuuuaugcgaaucuauuacucuugccaccggcccccugacaacccucugggaggguucaccagggaaguucuggaauacuacgaucgcggugagcauggccaacauuuuuagaggauccuaccuagcaggcgcuggucuggccuucaguuugaugaaaucucugggcgggggaaggcgcggcacaggggcacagggagagacccucggcgaaaaguggaaacggcagcuuaaucagcugagcaagucagaguucaacacuuauaagagauccgguaucaccgaagucgaccguagugaggcuaaagaaggguugaagaggggagagacaacuaaacacgccguuagccggggcaccgccaagcugcgcugguuuguggagcgaaaucucgucaaaccugaagguaaggugauagauuuaggcugugggagaggaggcuggucuuacuauugcgcggggcugaagaaaguaacagaggugaagggauacacgaaaggcggucccgggcacgaagagccgaucccaauggcuaccuacggauggaaccuuguuaagcugcauuccggcaaagacguguucuuuauuccucccgaaaagugugauacucuacucugcgacaucggcgagucaagcccaaaucccacaauugaggaagggaggacccugcgggucuugaaaaugguggagccuuggcugcgcggaaaccaauucuguaucaagauucucaauccguauaugcccucggucguggaaacucuugagcagaugcagagaaagcacgguggcaugcugguuaggaacccauuaucucgaaauaguacacaugagauguacuggguauccugcgggaccggaaacaucgugagcgcagucaauaugacgucacggaugcuguugaaccguuuuaccauggcccacagaaaaccuacauaugaacgcgauguggaccucggcgcugguacuaggcacguugccguggagcccgaagucgcaaaccuggauauaauugggcagcggaucgagaauaucaagcaugaacacaaauccaccuggcauuacgacgaggauaacccuuauaagacaugggccuaccacggaucuuaugaggugaaaccaagcggcagugcuuccagcaugguaaauggcgugguuaagcuacuuacuaagcccugggacgucauuccuauggugacccaaauagcgaugacagauaccacuccauucgggcagcagagaguguuuaaagaaaaggucgacacgcgcacacccaaagccaagaggggaaccgcacaaaucauggagguuacugcuaaauggcugugggguuuccucucucgaaacaagaagccgcggauuuguaccagagaagaguuuacaaggaaagugcgcucaaaugccgcaaucggcgccguauucguggacgaaaaccaguggaauagugcuaaggaggccgucgaggaugaacguuuuugggaccuggugcaucgggagagagaauugcacaaacaggggaagugcgcgacgugcguuuacaacaugaugggaaaaagggagaagaagcugggcgaauucgguaaagcaaaggggucccgcgccauuugguacauguggcucggagcucgauuucuugaguucgaggcccugggcuucaugaaugaagaucacugguuuagccgggagaacucuuuaucgggcguggaaggggagggacugcauaaauuggguuauauccucagagacauaucaaagaucccuggcgggaauauguacgcagaugacaccgcuggaugggauacuaggauuacagaggacgaucugcagaacgaagcccgcaucaccgacauuauggagccagaacacgcucuacuugccaaaagcaucuucaagcugacuuaucaaaauaaagucgugagaguacagcggcccgcaaagaacggcacaguuauggaugugauauccaggcgugaccagcgagguagugggcaggucggaaccuacggccucaauacauuuacuaacauggaggcgcaacugauucgccagauggaaucugagggcaucuucagcccuuccgaguuggaaaccccaaacuuagccgagagagugcuggauuggcucgaaaaguaugggguggagcggcuuaaaaggauggcuaucucaggagacgacugugucguuaagcccauugaugaccgcuuugccacggcacugaccgcucuaaaugauauggguaaagugagaaaggacauaccgcagugggaaccuaguaaaggcuggaacgauuggcagcaaguacccuucugcucucaucacuuucaccagcugaucaugaaggacgggcgggagauuguggucccauguaggaaucaggaugagcucgugggacgagcccguguuagccagggcgcagguugguccuugagagaaacagccugccuggggaagucauacgcgcaaauguggcagcuuauguauuuccaucgccgggaccugaggcucgcugccaacgcaaucuguagcgccgugccugucgauuggauucccacuucuagaaccacaugguccauccacgcucaucaccaguggaugacuaccgaggacauguuaaguguguggaaucgcguauggauagaagagaacccauggauggaagauaaaacgcauaucagcucguggggagacguucccuaccugggcaagcgggaggaccaauggugcggcuccuugauugggcugacagccagggcaaccugggcuacuaauauccagguggccauuaaccagguccgaagacucaucggaaaugagaacuaccuugauuauaugacaucuaugaaacgguuuaagaaugaaucagacccugagggugcgcugugguga

SEQ ID NO: 13303 - RNA, 9879 nt, Artificial Sequence
  derived and/or modified CDS sequence (opt3) from DENV-1__FJ639693__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaacaugugcacacugauugccauggaccucggagaguucugugaagauacuaugaccuacaaaugcccacggauaagugaagcggaaccggacgauguggacuguuggugcaaugcuacagauaccuggguaacuuaugggacauguagccaaaccggagaacaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuuacugacuuccaaucccaucagcugugggccaccuugcucucacugacguuuaucaaaacaaccuucagccuacacuaugcauggaagacuauggcuauggugcugaguauugucucucuuuuuccccucugucuguccaccacaagccagaagacuaccugguugccgguacuguuaggcucgcucgggugcaaaccucugacgauguuccuuaucgccgagaauaagauauggggaagaaaaucauggccacugaacgaagguaucauggccgugggcauuguuucuaucuugcucaguucccugcuaaagaacgaugugccccuggcugggccucuuauugcaggaggcaugcucaucgccuguuacgucauaagcgguucuagcgcggaccuguccuuggagaaagcugccgaggugucaugggaagaggaagcagagcauaguggggccagccacaauauuuuaguagaagugcaggaugacggaacaaugaagaucaaagaugaggagagggacgauacccugacuauccuccugaaggcuacacuucuggcagucucuggcguuuaucccuuguccauuccagccacccuauucgugugguacuuuuggcaaaagaaaaagcagcgaucaggcgugcugugggacacuccuagucccccagaagucgagcgcgcggugcucgaugacgggauauaucggaucaugcagagaggacugcuugguaggagccagguuggcguagggguguuccaagaaaacgucuuucauacaauguggcacgugacccguggagcuguuuuaauguaccagggcaaacgccuggagccguccugggccucugugaagaaagaccucauuucguacggugggggauggcgguugcagggcagcuggaauacgggcgaggaaguccaggugaucgcaguagagccugggaagaaccccaagaauguccaaacugccccaggaaccuucaaaacaucagaaggugaggugggcgcuauugcccuggauuuuaagcccgggaccuccggaaguccuaucguuaacagagaaggcaaaauagugggucucuaugggaauggagucgugacaacuucuggcaccuacguuagcgcaaucgcucaggccaaggcgucccaggagggcccacugcccgagauugaagacgagguguucaggaaacgaaaccuuacgaucauggaucugcacccugggucaggaaagacacggcgcuauuugccggccauugucagagaagcaaucaagaggaaacuacggacucugauacucgcuccaacccgagugguagccucugagauggcugaagcauuaaaggguaugcccauuagauaccaaacaaccgccgugaaaagcgagcauacuggcaaggagaucguugaccugaugugccacgccaccuuuacaaugcgccuucugaguccugucagggugccaaauuauaacaugaucauuauggaugaagcucauuucacggaccccuccagcaucgcggcacguggguacauaucuacucgggugggaaugggcgaggccgcugccauuuuuaugaccgcaacaccuccggguucagccgaggcuuucccccaguccaaugcggucauccaggaugaggaaagagacauuccagagaggaguuggaacagcggguaugaguggaucaccgauuuuccuggaaaaacuguaugguucgugcccucgauaaagucuggcaaugacauugccaacugucuccgcaagaauggcaaacgaguuauccaguuguccagaaagacauucgauaccgaauaccagaaaacgaagaacaacgacugggacuacguggucacuacagauaucagcgagaugggggcaaauuuucgggcugacagggugauugauccacgccguugccugaaaccuguuauccucaaggacggacccgaaagagugauucuggccgguccaaugccggucaccguggcaucagccgcucagcggaggggccgcauagggcgaaaccacaauaaggagggagaucaguauaucuacaugggccagccucuuaacaaugacgaggaucaugcccacuggaccgaagcgaaaaugcuacuggacaacauuaauacucccgaggguaucaucccagcauuguucgaacccgagagagaaaagagugccgcuauugauggggaguaucgguuaaggggcgaggcccgcaaaacauuuguagaacugaugagaaggggagaccucccuguguggcugucuuacaagguugcuuccgagggcuuccaauauagcgaucggcguuggugcuuugacggggaacgcaacaaucagguccuugaggaaaacauggauguggagauauggaccaaagagggagaacgaaagaaacugagaccaagguggcucgacgcacggacauacucagaccccuuggcccugcgcgaguucaaggaauuugcugccgguagaaggagugugagcggcgaucuaauccuggagauugggaagcucccucagcaccuuacucagcgggcacaaaaugcgcuggacaacuuagucauguugcauaauuccgaacagggaggccgagccuauagacacgcuauggaggagcugccggauacgaucgaaacccucaugcugcuugcccugauugcaguucucacagguggggugacuuuguucuuucugucuggccgcggauuaggcaaaaccagcaucgggcuacuguguguaauggcuuccucagugcuccuuuggauggccucugucgagccacauuggauagcagccaguaucauucuggaguucuuuuugauggugcugcucauccccgagccugacaggcagcggacaccccaggauaaccaacuggcuuacguugugauuggacuucucuucaugauccugaccgucgcggccaaugagauggguuugcuggaaacuacgaagaaagacuuaggcauagggcacguagcaguggagaaccaccaucacgcugccaugcuagauguugaccugcauccagccucggcauggacccucuacgcuguggccacaacuauuaucaccccuaugaugcgucacacaauugaaaacaccacugcgaauaucagccuuacagcuauagccaaccaggcagccauccugaugggauuggauaagggcuggcccauuuccaaaauggacaucggugucccacugcucgcucuggggugcuauucucaggugaauccucuuacguuaaccgcagccguccugaugcucguggcgcauuacgcuauuaucggcccgggauugcaagccaaggcaacuagagaggcccagaagaggacagcugccggcauaaugaaaaaccccaccguugaugggauuguggcaaucgaccuggauccaguaguguaugacgcuaaguuugaaaaacagcuaggacagaucaugcugcucauucuuuguaccucacaaauccuguugaugcgcacaacuugggcccugugcgagagcauaacgcucgcggucggcuuccagaccacacugugggaggguuccccugggaaguucuggaauacuaccauugccguuaguauggcaaacaucuuucggggaucuuacuuagcuggcgccggucuugcauucagccugaugaaaucacucggcgggggacgaagaggcacaggggcucagggagaaacccuaggcgagaaguggaagaggcagcugaaucaauuguccaaaagugaauuuaacacuuauaagcgcagcgguauuauggagguggaccggucugaagccaaagaggggcugaagagaggagagacgacaaaacacgccgucucccguggcaccgcgaagcucaggugguucguggaacggaaucuuguaaagcccgaggguaaagugaucgaucugggcugugggcgcggaggcuggucauacuauugcgcuggguugaagaaaguuacugaagugaagggauacaccaaaggcgguccagggcacgaggaaccuauacccauggcaacauacggauggaaccuggucaagcuccauagcggcaaagacguguuuuucgucccgccagagaagugugauacuuuacugugcgacaucggcgagucgucuccuaaucccaccauugaagaggggcgaacacuuagagugcugaagaugguugaaccauggcuaaggggaaaccaguuuuguaucaaaauucucaaucccuauaugccuaguguaguggagacgcuggagcagaugcagcggaagcacgguggcauguugguccgcaacccgcuguccagaaauagcacccaugaaauguacugggugucaugcgggacuggaaacaucguuuccgccgugaauaugacaucuaggaugcuccuuaaccgauucaccauggcucaccggaaacccacuuaugagcgugaugucgaccugggcgccgguacaagacacguggcaguagaaccagagguggccaacuuagauauuaucgggcaacgcauagaaaauauuaagcaugagcacaaaagcaccuggcauuacgacgaggauaacccuuauaagacgugggcuuaccacggaaguuaugaaguuaagcccuccggcagcgcgucuucaauggucaauggcguggugaaacuguugaccaagccuugggacgucaucccaaugguuacacagaucgccaugacugauaccacacccuuugggcagcaaaggguguucaaagagaagguagacacucggaccccuaaagcaaagagaggaacagcucagauuauggaagugaccgccaaguggcucugggguuuucugagucgcaacaaaaagccaaggauauguacucgagaggaguucacgcggaaagucagauccaaugcagccaucggcgcuguguuuguugacgagaaccaguggaauagcgccaaggaggcgguggaagaugagagguucugggaccuaguccaucgcgaacgugagcuucacaaacaggggaagugcgcaacaugcguguacaacaugaugggaaagcgggagaaaaagcugggcgaguucgguaaagccaaggggucuagagcuauuugguacauguggcucggagccagguuucuggaguucgaagcauugggcuuuaugaaugaggaucacugguucucgcgcgaaaacucacugagcggcguagagggggagggacuccauaaacuugguuauauccugcgagacauuuccaagaucaguggcgggaauauguacgcugaugacaccgccggaugggauacucggauaaccgaagacgauuuacaaaacgaggcuaaaaucacagacauuauggaacccgagcacgcccuguuggcaaagucuaucuuuaagcucacguaucagaauaaaguugugagaguccagaggccggcgaagaacggcaccgugauggaugugauuagccgcagagaccagcgggguuccgggcaagucggaacuuacggccugaauacauucaccaacauggaagcccagcuaaucaggcagauggagucagagggcauauuuaguccuucugaacuugagacuccaaaccuggcugaacgugcccucgauuggcuggagaaacaugggguugaacgauugaagcgcauggcaauuagcggagacgacugugugguaaaacccaucgaugacagauucgcuacagccuuaaccgcacugaaugauauggguaaggugcggaaggacaucccucagugggagccauccaaaggcuggaacgauuggcaacagguccccuuuugcucacaccacuuccaucagcucauuaugaaggacgggagggagauagugguuccgugucgcaaucaggaugaacuugugggcagagcacgggucagccaaggcgcggguuggucucugagggagacagcuugccuagggaaauccuaugcccagauguggcagcugauguacuuucaccgacgugaccucagauuggcagccaacgcuaucuguagugccggaccuguggauuggguacccacuagccgcaccacguggucgauucaugcacaccaucaauggaugaccacagaagacaugcuguccguuuggaaucggguguggaucgaggaaaacccauggauggaggauaagacucacauuucuucaugggaggacgucccuuaucuuggcaaaagggaagaccaguggugcggcagccugaucgggcucaccgcuagagccacaugggcgacuaauauacagguggcuaucaaccagguucgccgguuaauuggaaaugagaacuaccuggauuacaugaccaguaugaagagguucaagaaugaauccgaccccgagggugccuugugguga

SEQ ID NO: 13304 - RNA, 9879 nt, Artificial Sequence
  derived and/or modified CDS sequence (opt3) from DENV-1__FJ639694__SS-prME
uccgugaccaugcugcucaugcuuaugcccacagcacuggcuuuccacuugacuacgcggggaggggagccucauaugaucgucuccaagcaggaaaggggaaaaucuuuacuguuuaagaccucagccgguguuaacaugugcacacugauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcacuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacuggaucguucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacauccuucagcaugaccuguaucgcugugggccugguuacacuauaccucggggucauggugcaggccgauucuggaugcgugaucaacuggaaaggccgcgaacugaagugugguucagggauuuuugucacuaaugagguucacaccuggacggaacaauauaaguuccaggcagacaguccgaaaagacuuagcgccgcuauaggaaaggccugggaggagggcgugugcgguaucagguccgcaacacgguuggaaaacauuauguggaaacagaucucuaacgagcugaaucauauucuccuggaaaacgacaugaaguuuaccgugguagucggcgauguggcugggaucuuagcccagggcaagaagaugauacgcccucaacccauggaguacaaauauucguggagaagcuggggcaaggcgaagaucauuggggccgacguucagaauacuaccuucaucauugauggaccaaacacaccugaaugucccgacgaucagagggcuuggaauaucugggagguggaggacuacggcuuugguauauucacuaccaacauuuggcugaaacuucgugauuccuauacacaggucugcgaccaccgguugaugucagcagccaucaaggauaguaaagcugugcacgccgacaugggguacuggauugaaucugagaagaaugaaacguggaaacucgcacgagcgagcuucaucgagguuaagaccuguauauggccaaagucccauacucuguggucaaacggagugcuagaaagcgagaugaucauucccaaaaucuauggcgguccuauuucucaacacaauuacagaccaggcuacuuuacacagaccgccgggccguggcaucugggaaagcucgagcuggauuucgaccuuugcgaaggcacuacaguagucguggaugagcacugcgggaacaggggacccuccuugcgcaccacgacugugaccggcaaaaucauacacgaaugguguugccggaguuguacacugccuccauuaagauuuaggggugaggacgggugcugguauggaauggagauucgccccgucaaggaaaaagaggaaaaucucguuaagagcauggugucugcuggcuccggugagguagacucauucagucugggccuucuguguaucagcaucaugauugaagaggugaugcgaucgcgguggucccguaagauguugaugaccgggacucucgccgucuuucugcuacugaucaugggacagcucacauggaacgaucugauuagacuuugcauaauggugggcgcaaaugcuucugacaggauggggaugggaaccacauacuuggcccugauggcaacuuucaaaaugcgcccuauguuugccguuggcuuacucuuccggagacugaccagcagggaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaagaucuggggacgacgcagcuggccauugaacgaagguauuauggccguaggcaucgugucgauucuccugucaucucuacugaaaaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacaaugaaaaucaaggaugaggagcgggacgauacccucacuauucugcuuaaagcuacacuguuggcagugaguggcgucuauccccuaagcauaccagccacccuguucguuugguacuucuggcaaaagaaaaagcagagaucuggcgugcucugggacacgccuucacccccagaaguggagagggcgguccuggaugacgggaucuaucguauuaugcagcgcggacuuuuaggucggagccaggugggcguugggguauuucaagaaaacguguuccauacuauguggcacgucaccagaggagcugugcugauguaccagggcaagaggcucgagccgaguugggccagcguuaaaaaggacuugaucuccuacggugggggauggcgacugcagggcucuuggaauacaggcgaggaagugcaggucauugcaguggagccugggaaaaaccccaagaauguacaaaccgccccaggaacauuuaaaacucccgaaggugaggucggcgcuaucgcccucgauuucaagccugggaccucgggaagcccaauagugaaccgggaaggcaagaucguuggucuguaugggaauggaguggucacgacaucaggcacuuacguguccgcaauugcucaggccaaagcgagucaggagggcccccuuccugagaucgaagacgagguuuuucgcaagagaaaccugaccauuauggauuugcacccggggucuggaaaaacaaggcgguaucuaccagccaucgugcgagaagcaauaaagagaaaacugcgcacccucauuuuagcucccacuagggucguggccagcgagauggcugaagcacugaaggguaugccuauccguuaccaaaccacagccguaaaguccgagcauacgggcaaagagaucguggaccuuaugugccacgccacuuucaccaugcggcugcucucaccaguuagaguccccaauuauaacaugauuaucauggaugaagcucauuuuacagacccuucuagcauagcggcaaggggguacauuaguacccgcgugggaaugggcgaggccgcugccaucuucaugacugcaacaccgcccgguuccguggaagccuuuccacagagcaaugcugucauucaggaugaggaacgagacaucccugagagaucuuggaacucaggguaugaguggauaaccgauuuccccggaaagacgguaugguuugugccauccauuaaaaguggcaaugacaucgcgaacuguuugcggaagaauggcaaaaggguuauccagcugagccgcaagacuuucgauacagaauaccaaaagaccaaaaacaacgacugggacuacguggucaccacugauauuucggagaugggggccaauuuccgugcagacagagugaucgauccucggaggugccucaagcccguuauucugaaagacggaccagaacgcgugauacuugcugguccgaugccugucacaguggccucugcagcccagcgaagaggccggaucgggaggaaccacaauaaggagggagaucaguauauuuacaugggccagccccuaaacaaugacgaggaucaugcucacuggaccgaagccaaaaugcuguuggacaacaucaauacaccagaggguaucauucccgcguuauuugaaccugagcgcgaaaaguccgcagccauagauggggaguauagacugaggggcgaggcucggaagacuuucguagaacucaugcgucgcggagaccugccaguguggcuuagcuacaaaguugccucagagggcuuucaauauagugaucgaagauggugcuucgacggggaaaggaacaaucagguccuggaggaaaacauggauguggagaucuggacgaaggagggagaacggaaaaagcuccgccccagaugguuggacgcuaggaccuacucugacccucuggcacuacgggaguuuaaagaguucgccgcuggucgaagauccgugagcggcgaucugauucucgagaucgggaaacuuccgcagcaccugacacagcgcgcccaaaaugcauuagacaacuuggucaugcugcauaauucagaacagggaggcagggcguaucggcacgccauggaggagcucccagauacuauugaaacccugaugcuucuggcucucaucgccguuuugacagguggggugacccuguuuuucuuaaguggccguggacuaggcaaaacuagcauagggcugcucuguguaauggcauccucugugcuucuguggauggcuagcgucgagccccauuggaucgccgcauccauuaucuuggaauuuuuccugauggugcuccugauuccugagcccgacagacagaggacgccacaggauaaccaacuugccuacguugugaucggacuccuguuuaugauauugaccgucgcugcgaaugagaugggucuguuagaaacaacuaagaaggaccuaggcauugggcacguagccgugggaaaccaccaucacgcagcuaugcuggauguugaccuccauccugccucagccuggacccuuuacgcaguggcuacaaccaucauuacucccaugaugcgccacacaaucgagaacacgaccgccaauauaucucugacugcgaucgcuaaccaggccgcaauuuugaugggccuggauaaagguuggccaaucaguaagauggacauuggggucccucuccuggcccuuggcugcuauagccaggugaauccguuaacacugaccgcugcaguccucauguugguggcccauuacgcgaucauaggacccggccugcaagcuaaagccacccgggaagcacagaagcgaacagccgcugggauuaugaaaaacccaacuguugauggaaucguggccaucgaccuagauccuguaguguaugacgcaaaguucgagaagcagcugggccagauuaugcuccuuauccuguguacgagccaaauauugcugaugagaaccacaugggcucucugcgaauccauuacucuggccaccggucccuuaacaacccuuugggaggggucuccaggaaaauuuuggaauacuacgaucgcggucucaauggccaacauuuucaggggcagcuaccuggccggugcuggccucgccuucucccuaaugaagagucuagggggaggccgccgggggacaggagcacagggcgagaccuugggugaaaaauggaagagacagcugaaucagcucucuaaaagcgaguuuaacacuuauaagcguucagggaucauggaaguugacagguccgaggcuaaggaaggacuuaaacggggcgagauaaccaagcacgccgugagucgcgguacagccaaacugcgaugguucgucgagagaaauuuggugaagccugaaggcaaaguaaucgaucugggguguggaaggggcggguggagcuacuauugcgcgggacucaagaaggugacugagguuaaaggcuacaccaagggugggcccggacacgaggaaccgauuccaauggcuacauacggcuggaacuuagugaaacugcauucuggcaaggacgucuuuuucgugccucccgaaaaaugugauacgcuucugugcgacaucggggaguccucaccaaaucccaccauugaggaaggacggacucuacgcguccucaagaugguggagccuuggcugagagguaaccaauuuuguaucaaaauuuugaauccguauaugcccagcguuguagaaacacuggagcagaugcagaggaagcacggcgggaugcucgugcgaaacccacuuucgagaaauucuacccaugagauguacugggucaguugcggaacuggcaacaucguguccgcaguuaauaugacaagccguaugcuguuaaacagauucaccauggcccaccgcaagccuacguaugaaagggauguggaccugggugcugggacccggcacgucgccguggagcccgaaguagcaaacuuggauauaauuggacagagaaucgagaauaucaaacaugaacacaagucaacauggcauuacgacgaggauaacccuuauaaaacuugggccuaccacggcuccuaugaggugaagccaucuggcagcgcuaguuccaugguuaauggggucgugaaacuccugaccaagcccugggacgugauuccuauggucacacaaauagcgaugacugauaccacaccauuuggacagcagcgcguuuucaaggaaaaaguggacaccaggacucccaaggccaaacgagguacggcacaaaucauggagguaacagcuaaguggcuauggggcuuucuuagccggaacaaaaagccgagaauuuguaccagggaagaguucacucgcaaggugcguucuaaugccgcaaucggggccgucuuuguggacgaaaaccaguggaacucagcuaaagaggccguugaggaugaacgguucugggaccuggugcauagagagagggaacuccacaagcagggaaaaugcgcgaccugcgucuacaacaugaugggcaagcgcgagaaaaagcugggugaauuugggaaggcaaaaggaagucgagccauuugguacaugugguugggcgcucgguuccuggaguucgaggcccucggcuuuaugaaugaagaucacugguucuccagagagaacagccuuucugggguggaaggagagggucugcauaaguuaggcuauauccugagggacauaucgaaaaucccugggggaaauauguacgcagaugacacagcuggcugggauacgcgcauuaccgaggacgauuugcagaacgaagccagaaucacugacauuauggagccagaacacgcucuccuggccaagucaaucuuuaaacuaacauaucaaaauaagguaguucgggugcagaggcccgccaagaaugguaccgucauggaugugauaagccgucgagaccagcgcggguccggacaggugggcacuuacggccuuaauacauucaccaacauggaggcgcaacugauuagacagauggaaagugaggggaucuuuucuccuagcgagcucgaaacaccaaaccuggccgagcgggucuuggauugguuagaaaaguauggaguugagaggcugaagcgcauggcuaucuccggugacgacugugugguaaaacccauugaugacagauucgccacugcacucaccgcucuuaaugauaugggcaaggugcggaaagacauaccgcagugggaaccuucaaagggguggaacgauuggcagcaaguccccuuuugcagucaucacuuccaccagcugaucaugaaagacggaagggagauugugguuccaugucgaaaucaggaugagcuagugggccgugccagagucucucagggugcaggguggagccugcgcgaaacggccugccucggaaaguccuacgcgcaaauguggcaguugauguauuuucaucggagggaccugagacuugcugccaacgcaaucuguucagccgugccuguagauuggauucccaccagccgcacaacuuggucuauccacgcucaucaccaguggaugaccacagaggacaugcuguccguuuggaaucggguguggauagaagagaacccauggauggaagauaagacucauaucaguaauuggggcgacguccccuaccucggcaaaagggaggaccaauggugcgggagcuuaauuggacugaccgcccgagcaacgugggcuacaaacauccagguggccauuaaucagguuagacgguugaucgguaacgagaauuaccuggauuauaugaccucgaugaagagguucaaaaacgaauccgacccugagggcgcgcucugguga

SEQ ID NO: 13305 - RNA, 9879 nt, Artificial Sequence
  derived and/or modified CDS sequence (opt3) from DENV-1__FJ639695__SS-prME
uccgugaccaugcugcucaugcuuaugcccacagcccuggcuuuccacuugacuacgagaggaggggagccucauaugaucgucuccaagcaagaaagaggaaaaucuuuacuguuuaagaccucagcggguguuaacaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacugcucaagacagaggugaccaacccugccauucugaggaaacuuugcaucgaagcuaagauaucuaauacgaccacagauagccgguguccaacucaaggagaggccacccugguggaggaacaagacgcaaacuucgucugccgccgaacauuuguugauagaggcugggguaauggguguggauuguucggcaaaggcucccucaugacuugcgcuaaguuuaagugcgugaccaaacuggaggggaagauuguacaguacgaaaacuuaaaauauucagugaucgucacagugcacaccggagaccagcaucaaguugguaaugagaguacugaacacggcacgacagccaccauuacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauaggguugggcguacuccugacuugguuaggacuaaauucacgaaguacaucccuaagcaugaccuguaucgcugugggccucguuacacuguaccuuggggucauggugcaggccgauucuggaugcgugauuaacuggaaaggccgcgaauugaagugugguucagggaucuucgucacuaaugagguucacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccgugguagucggcgauguggcugggauccuugcccagggcaaaaagaugauucgcccucaacccauggaguacaaauauucguggaaaagcuggggcaaggcgaagaucauaggggccgacguucagaauacuaccuuuaucauugauggaccaaacacaccugaaugucccgacgaucagagagcuuggaauaucugggagguggaggacuacggcuucgguauuuuuacuaccaacaucugguugaagcucagggauuccuauacacaggucugcgaccaccgucugaugucagcagccauaaaagauaguaaggcugugcacgccgacaugggguacuggauugaaucugagaaaaaugaaacguggaagcuagcacgggcgagcuucaucgagguuaagaccuguauuuggccaaaaucccauacucuguggucaaacggagugcucgaaagcgagaugaucauacccaagaucuauggcgguccuauuucucaacacaauuaccgaccaggcuacuucacacagaccgccgggccguggcaucugggaaaacuugaguuggauuuugaccugugcgaaggcacuacaguagucguggaugagcacugcgggaacagaggacccuccuuaaggaccacgacugugaccggcaagaucauucacgaaugguguugccgcaguuguacacucccuccacugcgguucagaggugaggacgggugcugguauggaauggagaucaggcccgucaaagaaaaggaggaaaaucuuguuaagagcauggugucugcuggcuccggugagguagacucauuuagucugggcuugcucuguauaagcauuaugaucgaagaggugaugcgcucgcgauggucccggaaaaugcugaugaccgggacucuagccgucuuccugcuccugaucaugggacagcuuacauggaacgauuugauucgucugugcaucauggugggcgcaaaugcuucugacagaauggggaugggaaccacauacuuagcccucauggcaacuuuuaagaugaggccuauguucgccguuggccugcuuuuucgccggcugaccagcagagaggugcuacuccugacgauugguuugucacuggucgcuaguguggaauuaccaaacucccucgaggaacugggggauggacuugcgaugggcauaaugauccugaaauugcucacagacuuccaaucucaucagcugugggccacccuacugagccuuacuuuuauuaagaccacauucucccuccacuaugcauggaaaacuauggcuaugguucugucaaucgugagcuuguuuccccuguguuuaaguaccacgucucagaagacaaccuggcucccgguccugcuuggcucccuggggugcaagccuuugacuauguuccucauugccgagaauaaaaucuggggaaggcgaagcuggccacugaacgaagguauaauggccguaggcaucgugucgauucuacugucaucucuucucaagaacgauguuccccuggcugggccuuugaucgcaggaggcauguuaauugccuguuacgugaucagugguuccagcgcggaccugucucucgagaaagcugccgaggucagcugggaagaggaagcagagcauuccggggccucacacaauauacugguggaaguacaggaugacggaacaaugaagauuaaagaugaggagcgcgacgauacccuuacuauccuguugaaggcuacacuacuggcagugaguggcgucuauccccucagcaucccagccacccuguuuguuugguacuucuggcagaaaaagaagcagcggucuggcgugcuuugggacacgccuucacccccagaaguggagagagcggucuuagaugacgggauuuauaggauaaugcagcguggacugcucggucgcagccaggugggcguugggguauuccaagaaaacguguuucauacuauguggcacgucacccggggagcuguguugauguaccagggcaaaagacuggagccgaguugggccagcguuaagaaagaccucaucuccuacggugggggauggaggcugcagggcucuuggaauacaggcgaggaagugcaggucauugcaguggagccugggaagaaccccaaaaauguacaaaccgccccaggaacauucaagacucccgaaggugaggucggcgcuaucgcccuugauuuuaagccugggaccucgggaagcccaauugugaaccgagaaggcaaaaucguuggucuguaugggaauggaguggucacgacaucaggcacuuacguguccgcaauagcucaggccaaggcgagucaggagggccccuugccugagaucgaagacgagguuuuccggaaacgcaaccuaaccauuauggaucugcacccggggucuggaaagacaagaagguaucucccagccaucgugcgggaagcaauuaaacgaaaguuaagaacccugauccuugcucccacucgcgucguggccagcgagauggcugaagcacugaaggguaugccuauaagguaccaaaccacagccguaaaauccgagcauacgggcaaggagauuguggaccucaugugccacgccacuuuuaccaugcguuugcugucaccaguucggguccccaauuauaacaugaucaucauggaugaagcucauuucacagacccuucuagcauugcggcaagaggguacaucaguaccagggugggaaugggcgaggccgcugccauauuuaugacugcaacaccgcccgguuccguggaagccuucccacagagcaaugcugucauucaggaugaggaacgcgacaucccugagcgaucuuggaacucaggguaugaguggauuaccgauuuucccggaaaaacgguaugguucgugccauccaucaagaguggcaaugacauagcgaacugucucaggaaaaauggcaagcggguuauucagcugagcaggaagacuuuugauacagaauaccagaaaaccaagaacaacgacugggacuacguggucaccacugauaucucggagaugggggccaauuuccgcgcagaccgugugaucgauccuagacggugccuuaaacccguuauucuaaaggacggaccagaaagggugauccuggcugguccgaugccugucacaguggccucugcagcccagcgccgaggcagaauugggcggucccacaacaaagagggagaucaguauauauacaugggccagcccuugaauaacgacgaggaucaugcucacuggaccgaagccaagauguuacuggacaauaucaacacaccagaggguauuauccccgcacucuucgaaccugagagggaaaagagcgcagccaucgauggggaguaucgccugagaggcgaggcuaggaaaacuuuuguagaacuuaugcggcguggagaccugccaguguggcucucauacaagguugccagugagggcuuccaauauucugaucgccgauggugcuuugacggggaaagaaauaaccaggucuuggaggaaaauauggauguggagauuuggacgaaagagggagaaaggaagaaacugcggccccgcuggcuagacgcuagaaccuacuccgacccucuggcacucagggaguucaaggaauuugccgcuggucggcgaagcgugucaggcgaucuuauacuggagaucgggaaauuaccgcagcacuugacacagagagcccaaaacgcacuggacaaucucgucaugcugcauaacagugaacagggaggccgcgcguauaggcacgccauggaggagcuuccagauacuauugaaacccugaugcucuuggcucugaucgccguuuuaacagguggggugacccuauucuuucugagcggccggggacucggcaagacuuccauugggcuucuguguguaauggcaucuagcguguugcuguggauggcuuccgucgagccccauuggaucgccgcaucaauaauccucgaguucuuucugauggugcuucucauuccugagcccgaccgucagagaacgccacaggauaaucaacuggccuacguugugaucggauugcuguucaugauuuuaaccgucgcugcgaacgagaugggucuacuggaaacaacuaagaaagaccucggcaucgggcacguagccgugggaaaucaccaucacgcagcuaugcuugauguugaccugcauccugccucugccuggaccuuguacgcaguggcuacaaccauaauuacucccaugaugaggcacacaaucgagaacacgaccgccaacauuagucugacugcgaucgcuaaucaggccgcaauacucaugggccuggauaaggguuggccaaucucgaaaauggacauuggggucccucuuuuagcccugggcugcuauagccaggugaacccgcucacauugaccgcugcaguccugaugcuaguggcccauuacgcgaucauuggacccggccugcaagcuaaggccacccgcgaagcacagaaacggacagccgcugggaucaugaagaauccaacuguugauggaauaguggccauugaccucgauccuguaguguaugacgcaaaguuugagaaacagcuuggccagaucaugcuguugauccuguguacgucccaaauucuccugaugcgaaccacaugggcuuuaugcgaaucuaucacucuugccaccgguccccugacaacccucugggaggggucaccaggaaaguucuggaacacuacgauagcggucagcauggccaauauuuuuagaggcuccuaccuagcaggagcuggccuggccuucaguuugaugaaaucucuagggggaggcaggcgcgggacaggagcacagggcgagacccucggugaaaaguggaaacggcagcuuaaccagcugagcaagucagaguucaauacuuauaagagauccgggaucauggaaguugaccguagugaggcuaaagaaggauugaagaggggcgagaccacaaaacacgccgugagccgggguacugccaagcugcgcugguuugucgagcgaaaccucgugaaaccugaaggcaagguaauugauuuaggguguggaagaggcggguggucuuacuauugcgcgggacugaagaaagugaccgagguuaagggcuacacaaaaggugggcccggacacgaagaaccgaucccaauggcuacguacggcuggaaucuugugaagcugcauuccggcaaagacgucuucuuuauaccucccgaaaagugugauacccuacucugcgacaucggggagucaagcccaaaccccacuauugaggaaggaaggacacugcggguguugaaaauggucgagccuuggcugcgcgguaaucaauucuguaucaagauucucaacccguauaugcccucggugguugaaacccuugagcagaugcagagaaagcacggcgggaugcugguaaggaauccauuaucucgaaacaguacucaugagauguacuggguguccugcggaacaggcaauaucgucagcgcagugaacaugaccucacggaugcuguugaaucguuuuacgauggcccacagaaaaccuaccuaugaacgcgauguugaccucggugcugggacaaggcacguggccgucgagcccgaaguggcaaaccuggauauuaucggacagcggauagagaacauuaagcaugaacacaaauccacuuggcauuacgacgaggauaauccuuauaagaccugggccuaccacggcucuuaugagguaaaaccaagcggcagugcuuccagcauggugaacgggguugucaagcuacuuacaaagcccugggacgugaucccuauggugacucaaaucgcgaugaccgauacaaccccauucggacagcagagagucuuuaaagaaaagguugacacucgcacgcccaaagccaagagggguacagcacaaauuauggaggugaccgcuaaauggcuguggggcuuccucucucgaaauaagaagccgcggauauguacuagagaagaguuuaccaggaaaguacgcucaaacgccgcaaucggggccguguucgucgacgaaaaucaguggaacagugcuaaggaggccguggaggaugaacguuuuugggaccugguucaucgggagagagaauugcacaaacagggaaagugcgcgacaugcguguacaauaugaugggcaaaagggagaagaagcugggugaguucgggaaagcaaagggaucccgcgccauuugguacauguggcucggcgcucgauuucuugaguucgaggcccugggcuucaugaacgaagaucacugguuuagccgggaaaauucuuuaucgggggucgaaggagagggucugcauaaauugggcuauauccucagagacauuucaaagaucccugggggaaacauguacgcagaugacacggcuggcugggauaccaggauaacugaggacgaucugcagaaugaagcccgcaucacagacauuauggagccagaacacgcucuacuugccaaaagcaucuucaagcugaccuaucaaaacaaagugguaagaguucagcggcccgcaaagaaugguacugugauggaugucauuuccaggcgugaccagcgagggaguggacaggugggcacauacggccucaacaccuuuacaaauauggaggcgcaacugauccgccagauggaaucugaggggauauucagcccuuccgaguuggaaacuccaaacuuagccgagagagugcuggucuggcucgaaaaguauggaguugagcggcuuaaaaggauggcuauuucaggugaugacugugugguaaagcccaucgacgaucgcuuugccaccgcacugacggcucuaaacgacaugggcaaagugagaaaggauaucccgcagugggaaccuaguaaaggguggaaugacuggcagcaaguccccuucugcucucaucacuuucaccagcugauuaugaaggauggacgggagauagugguuccauguaggaaccaggacgagcucgugggccgagcccgugucagccagggugcagggugguccuugagagaaaccgccugccugggaaagucauacgcgcaaauguggcagcuuauguauuuccaucgccgggaucugaggcucgcugccaaugcaaucuguagcgccgugccuguagacuggauucccacaucuagaacuaccugguccauccacgcucaucaccaguggaugacaacugaggauauguuaaguguuuggaaccgcguguggauugaagagaauccauggauggaagacaaaacccauaucagcucguggggcgauguccccuaccugggcaagcgggaggaccaauggugcggguccuugauaggacugacggccagggcaacaugggcuaccaacauccagguggccauuaaucagguucgaagacucaucgguaacgagaauuaccuugacuauaugacuucuaugaaacgguuuaagaacgaaucagauccugagggcgcgcugugguga

SEQ ID NO: 13306 - RNA, 9879 nt, Artificial Sequence
  derived and/or modified CDS sequence (opt3) from DENV-1__FJ639696__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaacaugugcacacugauugccauggaccucggagaguucugugaagauacuaugaccuacaaaugcccacggauaagugaagcggaaccggacgauguggacuguuggugcaaugcuacagauaccuggguaacuuaugggacauguagccaaaccggagagcaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuuacugacuuccaaucccaucagcugugggccaccuugcucucacugacguuuaucaaaacaaccuucagccuacacuaugcauggaagacuauggcuauggugcugaguauugucucucuuuuuccccucugucuguccaccacaagccagaagacuaccugguugccgguacuguuaggcucgcucgggugcaaaccucugacgauguuccuuaucgccgagaauaagauauggggaagaaaaucauggccacugaacgaagguaucauggccgugggcauuguuucuaucuugcucaguucccugcuaaagaacgaugugccccuggcugggccucuuauugcaggaggcaugcucaucgccuguuacgucauaagcgguucuagcgcggaccuguccuuggagaaagcugccgaggugucaugggaagaggaagcagagcauaguggggccagccacaauauuuuaguagaagugcaggaugacggaacaaugaagaucaaagaugaggagagggacgauacccugacuauccuccugaaggcuacacuucuggcagucucuggcguuuaucccuuguccauuccagccacccuauucgugugguacuuuuggcaaaagaaaaagcagcgaucaggcgugcugugggacacuccuagucccccagaagucgagcgcgcggugcucgaugacgggauauaucggaucaugcagagaggacugcuugguaggagccagguuggcguagggguguuccaagaaaacgucuuucauacaauguggcacgugacccguggagcuguuuuaauguaccagggcaaacgccuggagccguccugggccucugugaagaaagaccucauuucguacggugggggauggcgguugcagggcagcuggaauacgggcgaggaaguccaggugaucgcaguagagccugggaagaaccccaagaauguccaaacugccccaggaaccuucaaaacaucagaaggugaggugggcgcuauugcccuggauuuuaagcccgggaccuccggaaguccuaucguuaacagagaaggcaaaauagugggucucuaugggaauggagucgugacaacuucuggcaccuacguuagcgcaaucgcucaggccaaggcgucccaggagggcccacugcccgagauugaagacgagguguucaggaaacgaaaccuuacgaucauggaucugcacccugggucaggaaagacacggcgcuauuugccggccauugucagagaagcaaucaagaggaaacuacggacucugauacucgcuccaacccgagugguagccucugagauggcugaagcauuaaaggguaugcccauuagauaccaaacaaccgccgugaaaagcgagcauacuggcaaggagaucguugaccugaugugccacgccaccuuuacaaugcgccuucugaguccugucagggugccaaauuauaacaugaucauuauggaugaagcucauuucacggaccccuccagcaucgcggcacguggguacauaucuacucgggugggaaugggcgaggccgcugccauuuuuaugaccgcaacaccuccggguucagucgaagccuucccccaguccaaugcuguaauccaggaugaggaaagagacauuccagagaggaguuggaacagcggguaugaguggaucaccgauuuuccuggaaaaacugugugguucguucccucgauaaagucuggcaaugacauugcgaacugucuccgcaagaauggcaaacgagugauccaguuguccagaaagacauucgauaccgaauaccagaagacgaagaacaacgacugggacuacgucgugacuacagauaucagcgagaugggggccaauuuucgggcagacaggguuauugauccacgccguugccugaaaccugugauccucaaggacggacccgaaagagucauucuggcugguccaaugccggugaccguagccucagcagcccagcggaggggccgcauagggcgaaaccacaauaaggagggagaucaguauaucuacaugggccagccucuuaacaaugacgaggaucaugcucacuggaccgaagccaaaaugcuacuggacaacauuaauacucccgaggguaucaucccagcguuguucgaacccgagagagaaaagagugcagccauugauggggaguaucgguuaaggggcgaggcucgcaaaacauuuguggaacugaugagaaggggagaccucccuguuuggcugucuuacaaggucgccuccgagggcuuccaauauagcgaucggcguuggugcuuugacggggaacgcaacaaucaggugcuugaggaaaacauggauguggagauauggaccaaagagggagaacgaaagaaacugagaccaagguggcucgacgcucggacauacucagaccccuuggcacugcgcgaguucaaggaauuugccgcugguagaaggagugucagcggcgaucuaauccuggagauugggaagcucccucagcaccuuacucagcgggcccaaaaugcacuggacaacuuaguuauguugcauaauuccgaacagggaggccgagcguauagacacgccauggaggagcugccggauacgaucgaaacccucaugcugcuugcucugauugccgugcucacaggugggguaacuuuguucuuucugucuggccgcggauuaggcaaaaccagcaucgggcuacugugugugauggcauccucaguccuccuuuggauggcuucuguggagccacauuggauagccgcaaguaucauucuggaguucuuuuugaugguucugcucauccccgagccugacaggcagcggacaccccaggauaaccaacuggccuacguggucauuggacuucucuucaugauccugaccguagcugcgaaugagauggguuugcuggaaacuacgaagaaagacuuaggcauagggcacguggccguugagaaccaccaucacgcagcuaugcuagauguggaccugcauccagccucggccuggacccucuacgcagucgcuacaacuauuaucaccccuaugaugcgucacacaauugaaaacaccacugccaauaucagccuuacagcgauagcuaaccaggccgcaauccugaugggauuggauaagggcuggcccauuuccaaaauggacaucggugugccacugcucgcccuggggugcuauucucaggucaauccucuuacguuaaccgcugcagugcugaugcucguugcccauuacgcgauuaucggcccgggauugcaagcuaaggccacuagagaggcacagaagaggacagccgcuggcauaaugaaaaaccccaccguggaugggauuguagccaucgaccuggauccaguggucuaugacgcaaaguuugaaaaacagcuaggacagaucaugcugcucauucuuuguaccucacaaauccuguugaugcgcacaacuugggcucugugcgagagcauaacgcucgccaccggcccucugacaacuuuaugggaggguucccccgggaaguucuggaauaccacaauugcgguuaguauggccaacaucuuccggggaucuuaccuugcaggcgcuggucuggccuuuagccucaugaaaucacuaggcgggggacgaagaggcaccggggcacagggagaaacucugggcgagaaguggaagaggcaguugaaucagcuguccaaaagugaguucaacacguauaagcgcagcgguauuauggagguggaccggucugaagcuaaagaggggcucaagagaggagagacaaccaaacacgccgucucccguggcacugccaaacuuaggugguuuguggaacggaaucugguaaagccagaggguaaagugaucgauuugggcugugggcgcggaggcuggucauacuauugcgcggggcugaagaaaguuaccgaagugaagggauacacaaaaggcgguccugggcacgaggaacccauaccgauggcuacuuacggauggaaccucgucaaguuacauagcggcaaagacguguucuuugucccaccugagaagugugauacccugcuuugcgacaucggcgagucgucucccaauccaacaauugaagaggggcgaacgcugagagugcuaaagaugguugaacccuggcucaggggaaaccaauucuguaucaaaauucugaauccuuauaugccgaguguaguggagaccuuggagcagaugcagcggaagcacgguggcaugcugguccgcaacccccucuccagaaauagcacucaugaaauguacugggugucaugcgggacaggaaacaucguuuccgcagugaauaugaccucuaggaugcuucugaaccgauuuacuauggcccaccggaaaccaacauaugagcgugaugucgacuuaggcgcugguaccagacacguggccguagaaccugagguggcaaaccuggauauuaucgggcagcgcauagaaaauauuaagcaugagcacaaaagcacguggcauuacgacgaggauaaccccuauaagaccugggccuaccacggaaguuaugaaguuaagccuuccggcagcgcuucuucaauggucaauggcguggugaaauugcucacaaagccaugggacgucauccccaugguuacucaaaucgcgaugaccgauacaacuccuuucgggcagcagaggguguuuaaagagaagguagacacccggacaccaaaagccaagagaggaaccgcacaaauuauggaagugacugcuaaguggcugugggguuuccuaagucgcaacaaaaagcccaggauauguacgcgagaggaauuuacacggaaagucagauccaaugccgcaaucggcgccguguucguugacgagaaccaguggaauagcgcuaaggaggccguggaagaugagagguuuugggaccuuguccaucgcgaacgugagcugcacaaacaggggaagugcgcgaccugcguguacaacaugaugggaaagcgggagaaaaagcucggcgaguucgguaaagcaaaggggucuagagccauuugguacauguggcugggagcuagguucuuggaguuugaagcccugggcuucaugaaugaggaucacugguuuucgcgcgaaaacucacucagcggcguagagggggagggacuucauaaacuggguuauaucuuacgagacauuuccaagaucaguggcgggaauauguacgcagaugacacugcuggaugggauacccggauaacagaagacgaucugcagaacgaggccaaaaucacggacauuauggaaccggagcacgcuuugcucgccaagucuaucuucaagcugaccuaucaaaauaaaguugugagaguccagaggccugcaaagaacggcacugugauggaugugauuagccgcagagaccagcgggguuccgggcaggucggaacauacggccuaaauaccuuuacuaacauggaagcgcaacuuaucaggcagauggagucagagggcauauucaguccaucugaacuggagacacccaaccucgccgaacgugcucuggauugguuggagaaacaugggguugaacgauuaaagcgcauggccauuagcggagacgacugugugguaaaaccuaucgaugacagauuugcaaccgcucugacagcccucaaugauauggguaaggugcggaaggacaucccacagugggagcccuccaaaggcuggaacgauuggcagcaagucccguucugcucacaccacuuucaucagcuuauuaugaaggacgggagggagauagugguuccuugucgcaaucaggaugaacuggugggcagagcacgggucagccagggcgccgguuggucucuaagggagacugcgugccuggggaaauccuaugcucaaauguggcagcucauguacuuccaccgacgugacuugagacuggccgcaaacgccaucuguagugcugugcccguagauuggguuccaaccagccgcacgaccuggucgauucaugcccaccaucaguggaugacaacugaagacaugcuuuccguguggaaucgggucuggaucgaggaaaacccuuggauggaggauaagacccacauuucuucaugggaggacgugcccuaucugggaaaaagggaagaccaauggugcggcagccucaucggcuuaacagcaagagcuacuugggccaccaauauacagguugcgaucaaccaggugcgccggcugauugggaaugagaacuacuuggauuacaugacgaguaugaagagguuuaagaaugaauccgaccuggagggagcucucugguga

SEQ ID NO: 13307 - RNA, 9879 nt, Artificial Sequence
  derived and/or modified CDS sequence (opt3) from DENV-1__HM181937__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccuggcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcuuaaguugagggauuccuauacacaggucugcgaccaccgucucaugucagcagccaucaaagauaguaaggcugugcacgccgacaugggguacuggauugaaucugagaaaaaugaaacguggaagcuggcacgggcgagcuucaucgagguuaagaccuguauauggccaaaaucccauacucuauggucaaacggagugcuggaaagcgagaugaucauucccaagaucuauggcgguccuauuucucaacacaauuaccgaccaggcuacuucacacagaccgccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggaaaaugcucaugaccgggacucuggccgucuuccuacugcucaucaugggacagcugacauggaacgaucuuauucguuugugcauaauggugggcgcaaaugcuucugacagaauggggaugggaaccacauaccuggccuuaauggcaacuuuuaagaugaggccuauguucgccguuggccuccuguuucgccggcuuaccagcagagaggugcugcuacucacgaucggucugucauuggucgcuaguguggaacugccaaacuccuuagaggaacucggggauggacuggcgaugggcauuaugauccuuaaacuguugacagacuuccaaucucaucagcucugggccacccugcuaagccugacuuuuauuaagaccacauucucccuucacuaugcauggaaaacuauggcuaugguucucucaaucgugagccuguuucccuugugucugaguaccacgucucagaagacaaccugguuaccgguccuccugggcucccuugggugcaagccucugacuauguucuugauagccgagaauaaaaucuggggaaggcgaagcuggccacucaacgaagguauuauggccguaggcaucgugucgauucugcuaucaucucugcuuaagaacgauguuccccucgcugggccucugaucgcaggaggcauguugauagccuguuacgugauuagugguuccagcgcggacuuaucucuggagaaagcugccgaggucagcugggaagaggaagcagagcauuccggggccucacacaauauccucguggaaguacaggaugacggaacaaugaagaucaaagaugaggagcgcgacgauacccugacuauucuucugaaggcuacauugcuagcagugaguggcgucuauccccugagcauaccagccacccucuuuguuugguacuucuggcagaaaaagaagcagcggucuggcgugcugugggacacgccuucacccccagaaguggagagagcgguccuugaugacgggaucuauaggauuaugcagcguggauuacugggucgcagccaggugggcguugggguauuccaagaaaacguguuucauacuauguggcacgucacccggggagcugugcucauguaccagggcaaaagauuggagccgaguugggccagcguuaagaaagaccugaucuccuacggugggggauggaggcuccagggcucuuggaauacaggcgaggaagugcaggucauugcaguggagccugggaagaaccccaaaaauguacaaaccgccccaggaacauucaagacucccgaaggugaggucggcgcuaucgcccuggauuuuaagccugggaccucgggaagcccaauagugaaccgagaaggcaaaaucguuggucuuuaugggaauggaguggucacgacaucaggcacuuacguguccgcaauugcucaggccaaggcgagucaggagggcccccugccugagaucgaagacgagguuuuccggaaacgcaacuugaccauuauggaucuacacccggggucuggaaagacaagaagguaucugccagccaucgugcgggaagcaauaaaacgaaagcucagaaccuuaauucuggcucccacucgcgucguggccagcgagauggcugaagcacuuaaggguaugccuaucagguaccaaaccacagccguaaaauccgagcauacgggcaaggagaucguggaccugaugugccacgccacuuuuaccaugcgucucuugucaccaguucggguccccaauuauaacaugauuaucauggaugaagcucauuucacagacccuucuagcauagcggcaagaggguacauuaguaccagggugggaaugggcgaggccgcugccaucuuuaugacugcaacaccgcccgguuccguggaagccuucccacagagcaaugcugucauucaggaugaggaacgcgacaucccugagcgaucuuggaacucaggguaugaguggauaaccgauuuucccggaaaaacgguaugguucgugccauccauuaagaguggcaaugacaucgcgaacugucugaggaaaaauggcaagcggguuauccagcucagcaggaagacuuuugauacagaauaccagaaaaccaagaacaacgacugggacuacguggucaccacugauauuucggagaugggggccaauuuccgcgcagaccgugugaucgauccuagacggugccugaaacccguuauucuuaaggacggaccagaaagggugauacuagcugguccgaugccugucacaguggccucugcagcccagcgccgaggcagaaucgggcggaaccacaauaaagagggagaucaguauauuuacaugggccagccccugaacaaugacgaggaucaugcucacuggaccgaagccaagauguuguuagacaacaucaauacaccagaggguaucauucccgcgcuguucgaaccugagagggaaaaguccgcagccauagauggggaguaucgccucagaggcgaggcuaggaaaacuuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacgaaagagggagaaaggaagaaauugcggccccgcuggcuggacgcuagaaccuacucugacccucuagcacugagggaguucaaggaauuugccgcuggucggcgauccgugagcggcgaucucauucuugagaucgggaaacugccgcagcacuuaacacagagagcccaaaaugcauuggacaaccuggucaugcuccauaauucagaacagggaggccgcgcguauaggcacgccauggaggagcugccagauacuauugaaacccuuaugcugcucgcuuugaucgccguucugacagguggggugaccuuauucuuucuaaguggccggggacugggcaagacuagcauagggcuccuuuguguaauggcauccucugugcuguuguggauggcuagcgucgagccccauuggaucgccgcauccauuauccuggaguucuuucucauggugcugcuuauuccugagcccgaccgucagagaacgccacaggauaaccaacucgccuacguugugaucggacuguuguucaugauacugaccgucgcugcgaaugagauggguuuacuagaaacaacuaagaaagaccugggcauugggcacguagccgugggaaaccaccaucacgcagcuaugcucgauguugaccuucauccugccucagccuggacccuguacgcaguggcuacaaccaucauuacucccaugaugaggcacacaaucgagaacacgaccgccaauauaucuuugacugcgaucgcuaaccaggccgcaauucugaugggccucgauaaggguuggccaaucaguaaaauggacauuggggucccucugcuugccuuaggcugcuauucgcaagugaauccgcugacacucaccgcugcagucuugaugcugguggcccauuacgcgaucauaggacccggccuacaagcuaaggccacccgcgaagcacagaaacggacagccgcugggauuaugaagaacccaacuguugauggaaucguggccaucgaccuggauccuguaguguaugacgcaaaguuugagaaacagcucggccagauuaugcuucugaucuuguguacgagccaaauacugcucaugcgaaccacaugggcucugugcgaauccauuacuuuagccaccgguccccuuacaacccugugggaggggucuccaggaaaguucuggaauacuacgaucgcggucucaauggccaacauuuuuagaggcagcuaccucgcaggagcuggccuagccuucucccugaugaaaagucuagggggaggcaggcgcgggacaggagcacagggcgagacccugggugaaaaguggaaacggcagcucaaucagcuuucuaagagcgaguucaacacuuauaagagaucagggaucauggaaguugaccguuccgaggcuaaagaaggacugaagaggggcgagaccacaaaacacgccgugagucgggguacugccaaguugcgcugguuugucgagcgaaaucuggugaaaccugaaggcaagguaauagaucucggguguggaagaggcggguggagcuacuauugcgcgggauuaaagaaagugaccgagguuaagggcuacacaaaaggugggcccggacacgaagaaccgaucccaauggcuacguacggcuggaaccuggugaaacuucauucuggcaaagacgucuucuuuauuccucccgaaaagugugauacccugcuaugcgacaucggggaguccucaccaaaucccacuauugaggaaggaaggacacuccgggugcugaaaauggucgagccuugguugcgcgguaaccaauucuguaucaagauucugaauccguauaugcccagcgugguugaaacccucgagcagaugcagagaaagcacggcgggaugcuuguaaggaacccacugucgcgaaauucuacucaugagauguacugggugaguugcggaacaggcaacaucgucuccgcagugaauaugaccagccggauguuacugaaccguuuuacgauggcccacagaaaaccuaccuaugaacgcgauguugacuugggugcugggacaaggcacguggccgucgagcccgaaguggcaaaccucgauauaauuggacagcggaucgagaauaucaagcaugaacacaaaucaacuuggcauuacgacgaggauaacccuuauaagaccugggccuaccacggcuccuaugagguaaaaccaucuggcagcgcuaguuccauggugaaugggguugucaagcugcuaacaaagcccugggacgugauuccuauggugacucaaauagcgaugaccgauacaaccccauucggacagcagagagucuuuaaagaaaagguugacacucgcacgcccaaagccaagagggguacagcacaaaucauggaggugaccgcuaaauggcuuuggggcuuccugagccgaaacaagaagccgcggauuuguacuagagaagaguuuaccaggaaaguacgcucuaaugccgcaaucggggccguguucgucgacgaaaaccaguggaacucagcuaaggaggccguggaggaugaacguuuuugggaccucguucauaaagagcgggaacugcacaagcagggaaaaugcgcgacaugcguguacaacaugaugggcaagagagagaagaaauugggugaguucgggaaggcaaaaggaaguagggccauuugguacauguggcugggcgcucgcuuucucgaguucgaggcccuuggcuucaugaaugaagaucacugguuuucccgagagaacagccugucuggggucgaaggagaggguuuacauaagcugggcuauaucuugcgggacauaucgaaaaucccugggggaaauauguacgcagaugacacggcuggcugggauaccagaauuacugaggacgaucuccagaacgaagccaggaucacagacauuauggagccagaacacgcucugcuagccaagucaaucuucaaacuuaccuaucaaaauaaggugguacgcguucagagacccgcaaagaacgguacugugauggaugucauaagccggagggaccagcguggguccggacaggugggcacauacggccugaauaccuuuacaaacauugaggcgcaacucauccgacagauggaaagugaggggaucuucucuccuagcgagcuggaaacuccaaacuuggccgagcgcguguuagauuggcuggaaaaauauggagucgagagacucaagcggauggcuauuuccggugacgacuguguugugaaacccauagaugacagguuugccaccgcacuuacggcucugaaugauaugggcaagguacgcaaagacaucccgcagugggaaccuucaaagggguggaacgauuggcagcaagugcccuucugcagucaucacuuucaccagcuaauuaugaaggacggaagagagaucgucgugccaugucggaaucaggaugagcugguuggcagggcccgagugucucagggugcaggguggagccuccgugaaaccgccugcuugggaaaauccuacgcgcaaauguggcagcugauguauuuccauagacgcgaccuucggcuggcugccaacgcaauuuguucagccgucccuguggauuggauccccacaagcaggacuaccuggucuauacacgcucaucaccaguggaugacaacugaggacaugcucuccguauggaauagaguuuggaucgaagagaacccauggauggaagauaagacccauauuaguagcuggggcgacgugcccuacuuaggcaaacgcgaggaccaauggugcgggucgcugaucggauugacggcccgggcaacaugggcuaccaauauucaggucgccaucaaccaggugaggcgacugauugguaaugagaacuaccucgauuauaugacuuccaugaagagauuuaaaaaugaaucugacccugagggcgcgcuuugguga

SEQ ID NO: 13308 - RNA, 9879 nt, Artificial Sequence
  derived and/or modified CDS sequence (opt3) from DENV-1__HM181939__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaacaugugcacacugauugccauggaccucggcgaguucugugaagauacuaugaccuacaaaugcccacggauaagugaagcggaaccggacgauguggacuguuggugcaaugcuacagauaccuggguaacuuaugggacauguagccaaaccggagagcaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuuacugacuuccaaucccaucagcugugggccaccuugcucucacugacguuuaucaaaacaaccuucagccuacacuaugcauggaagacuauggcuauggugcugaguauugucucucuuuuuccccucugucuguccaccacaagccagaagacuaccugguugccgguacuguuaggcucgcucgggugcaaaccucugacgauguuccuuaucgccgagaauaagauauggggaagaaaaucauggccacugaacgaagguaucauggccgugggcauuguuucuaucuugcucaguucccugcuaaagaacgaugugccccuggcugggccucuuauugcaggaggcaugcucaucgccuguuacgucauaagcgguucuagcgcggaccuguccuuggagaaagcugccgaggugucaugggaagaggaagcagagcauaguggggccagccacaauauuuuaguagaagugcaggaugacggaacaaugaagaucaaagaugaggagagggacgauacccugacuauccuccugaaggcuacacuucuggcagucucuggcguuuaucccuuguccauuccagccacccuauucgugugguacuuuuggcaaaagaaaaagcagcgaucaggcgugcugugggacacuccuagucccccagaagucgagcgcgcggugcucgaugacgggauauaucggaucaugcagagaggacugcuugguaggagccagguuggcguagggguguuccaagaaaacgucuuucauacaauguggcacgugacccguggagcuguuuuaauguaccagggcaaacgccuggagccguccugggccucugugaagaaagaccucauuucguacggugggggauggcgguugcagggcagcuggaauacgggcgaggaaguccaggugaucgcaguagagccugggaagaaccccaagaauguccaaacugccccaggaaccuucaaaacaucagaaggugaggugggcgcuauugcccuggauuuuaagcccgggaccuccggaaguccuaucguuaacagagaaggcaaaauagugggucucuaugggaauggagucgugacaacuucuggcaccuacguuagcgcaaucgcucaggccaaggcgucccaggagggcccacugcccgagauugaagacgagguguucaggaaacgaaaccuuacgaucauggaucugcacccugggucaggaaagacacggcgcuauuugccggccauugucagagaagcaaucaagaggaaacuacggacucugauacucgcuccaacccgagugguagccucugagauggcugaagcauuaaaggguaugcccauuagauaccaaacaaccgccgugaaaagcgagcauacuggcaaggagaucguugaccugaugugccacgccaccuuuacaaugcgccuucugaguccugucagggugccaaauuauaacaugaucauuauggaugaagcucauuucacggaccccuccagcaucgcggcacguggguacauaucuacucgggugggaaugggcgaggccgcugccauuuuuaugaccgcaacaccuccggguucagucgaagccuucccccaguccaaugcuguaauccaggaugaggaaagagacauuccagagaggaguuggaacagcggguaugaguggaucaccgauuuuccuggaaaaacugugugguucguucccucgauaaagucuggcaaugacauugcgaacugucuccgcaagaauggcaaacgagugauccaguuguccagaaagacauucgauaccgaauaccagaagacgaagaacaacgacugggacuacgucgugacuacagauaucagcgagaugggggccaauuuucgggcagacaggguuauugauccacgccguugccugaaaccugugauccucaaggacggacccgaaagagucauucuggcugguccaaugccggugaccguagccucagcagcccagcggaggggccgcauagggcgaaaccacaauaaggagggagaucaguauaucuacaugggccagccucuuaacaaugacgaggaucaugcucacuggaccgaagccaaaaugcuacuggacaacauuaauacucccgaggguaucaucccagcguuguucgaacccgagagagaaaagagugcagccauugauggggaguaucgguuaaggggcgaggcucgcaaaacauuuguggaacugaugagaaggggagaccucccuguuuggcugucuuacaaggucgccuccgagggcuuccaauauagcgaucggcguuggugcuuugacggggaacgcaacaaucaggugcuugaggaaaacauggauguggagauauggaccaaagagggagaacgaaagaaacugagaccaagguggcucgacgcucggacauacucagaccccuuggcacugcgcgaguucaaggaauuugccgcugguagaaggagugucagcggcgaucuaauccuggagauugggaagcucccucagcaccuuacucagcgggcccaaaaugcacuggacaacuuaguuauguugcauaauuccgaacagggaggccgagcguauagacacgccauggaggagcugccggauacgaucgaaacccucaugcugcuugcucugauugccgugcucacaggugggguaacuuuguucuuucugucuggccgcggauuaggcaaaaccagcaucgggcuacugugugugauggcauccucaguccuccuuuggauggcuucuguggagccacauuggauagccgcaaguaucauucuggaguucuuuuugaugguucugcucauccccgagccugacaggcagcggacaccccaggauaaccaacuggccuacguggucauuggacuucucuucaugauccugaccguagcugcgaaugagauggguuugcuggaaacuacgaagaaagacuuaggcauagggcacguggccguugagaaccaccaucacgcagcuaugcuagauguggaccugcauccagccucggccuggacccucuacgcagucgcuacaacuauuaucaccccuaugaugcgucacacaauugaaaacaccacugccaauaucagccuuacagcgauagcuaaccaggccgcaauccugaugggauuggauaagggcuggcccauuuccaaaauggacaucggugugccacugcucgcccuggggugcuauucucaggucaauccucuuacguuaaccgcugcagugcugaugcucguugcccauuacgcgauuaucggcccgggauugcaagcuaaggccacuagagaggcacagaagaggacagccgcuggcauaaugaaaaaccccaccguggaugggauuguagccaucgaccuggauccaguggucuaugacgcaaaguuugaaaaacagcuaggacagaucaugcugcucauucuuuguaccucacaaauccuguugaugcgcacaacuugggcucugugcgagagcauaacgcucgccaccggcccucugacaacuuuaugggaggguucccccgggaaguucuggaauaccacaauugcgguuaguauggccaacaucuuccggggaucuuaccuugcaggcgcuggucuggccuuuagccucaugaaaucacuaggcgggggacgaagaggcaccggggcacagggagaaacucugggcgagaaguggaagaggcaguugaaucagcuguccaaaagugaguucaacacguauaagcgcagcgguauuauggagguggaccggucugaagcuaaagaggggcucaagagaggagagacaaccaaacacgccgucucccguggcacugccaaacuuaggugguuuguggaacggaaucugguaaagccagaggguaaagugaucgauuugggcugugggcgcggaggcuggucauacuauugcgcggggcugaagaaaguuaccgaagugaagggauacacaaaaggcgguccugggcacgaggaacccauaccgauggcuacuuacggauggaaccucgucaaguuacauagcggcaaagacguguucuuugucccaccugagaagugugauacccugcuuugcgacaucggcgagucgucucccaauccaacaauugaagaggggcgaacgcugagagugcuaaagaugguugaacccuggcucaggggaaaccaauucuguaucaaaauucugaauccuuauaugccgaguguaguggagaccuuggagcagaugcagcggaagcacgguggcaugcugguccgcaacccccucuccagaaauagcacucaugaaauguacugggugucaugcgggacaggaaacaucguuuccgcaauuaauaugaccucuaggaugcuucugaaccgauuuacuauggcccaccggaaaccaacauaugagcgugauguggacuuaggcgcugguaccagacacgucgccguggaaccugagguagcaaaccuggauaucauagggcagcgcauugaaaauaucaagcaugagcacaaaagcacguggcauuacgacgaggauaaccccuauaagaccugggccuaccacggaaguuaugaagugaagccuuccggcagcgcuucuucaaugguuaauggcgucgugaaauugcucacaaagccaugggacgugauccccauggucacucaaauugcgaugaccgauacaacuccuuucgggcagcagaggguuuuuaaagagaagguggacacccggacaccaaaagccaagagaggaaccgcacaaauaauggaaguaacugcuaaguggcugugggguuuccuaagucgcaacaaaaagcccaggaucuguacgcgagaggaauuuacacggaaagugagauccaaugccgcaauuggcgccgucuucguggacgagaaccaguggaauagcgcuaaggaggccguugaagaugagagguuuugggaccuugugcaucgcgaacgugagcugcacaaacaggggaagugcgcgaccugcgucuacaacaugaugggaaagcgggagaaaaagcucggcgaguucgguaaagcaaaggggucuagagccaucugguacauguggcugggagcuagguucuuggaguuugaagcccugggcuucaugaaugaggaucacugguuuucgcgcgaaaacucacucagcggcguggagggggagggacuucauaaacuggguuauauuuuacgagacaucuccaagauaaguggcgggaauauguacgcagaugacacugcuggaugggauacccggaucacagaagacgaucugcagaacgaggccaaaauuacggacaucauggaaccggagcacgcuuugcucgccaauucuauuuucaagcugaccuaucaaaacaagguaguuagagugcagaggccugccaaaaauggcacugucauggaugugaucagccgcagagaccagcgggguuccggacaggugggaacauacggccuaaacaccuuuacuaacauggaagcgcaacuuauaaggcagauggagucagagggcauuuucaguccaucugaacuggagacacccaaucucgccgaacguguccuggauugguuggagaagcaugggguugaacgauuaaaacgcauggcuaucagcggagacgacugugugguaaagccuaucgaugacagauuugccaccgcacugacagcucucaacgauauggguaaagugcggaaggacauuccacagugggagcccuccaagggcuggaaugauuggcagcaagucccguucugcucacaccacuuucaucagcuuauaaugaaagacgggagggagaucgugguuccuugucgcaaccaggaugaacugguggggagagcacgggucagccagggcgcagguuggucucuaagggagacugccugccuggggaaguccuaugcgcaaauguggcagcucauguacuuccaccgacgugacuugagacuggcugccaaugcaauuuguagugccgugcccguagauuggguuccaaccagccgcacgaccuggucgauccaugcucaccaucaguggaugacaacugaagacaugcuuuccguguggaaccgggucuggauugaggaaaauccuuggauggaggauaaaacccacaucucuucaugggaggacgugcccuaucugggaaagagggaagaccaauggugcggcagccucauaggcuuaacagccagagcaacuugggcuaccaacauccagguugccauuaaucaggugcgccggcugaucgggaacgagaauuacuuggauuacaugacgaguaugaaaagguuuaagaacgaauccgacccagagggagcgcugugguga

SEQ ID NO: 13309 - RNA, 9879 nt, Artificial Sequence
  derived and/or modified CDS sequence (opt3) from DENV-1__HM181942__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaacaugugcacacugauugccauggaccucggcgaguucugugaagauacuaugaccuacaaaugcccacggauaagugaagcggaaccggacgauguggacuguuggugcaaugcuacagauaccuggguaacuuaugggacauguagccaaaccggagagcaccgccgagacaagcguuccguggcccuggcaccccaugucggccuuggucuggagacgagaacugaaaccuggaugucuucggagggggccuggaaacagauccagaggguggaaacaugggcuuugcggcacccuggauuuacuguuauugcacucuuccuggcccaugcuaucggcaccucaauuacacagaagggcaucauauuuauccugcucauguuagugaccccaagcauggccaugcgcugcgucgggauuggaaguagagauuucguggagggucuguccggcgcgacguggguagacguugugcuugagcacgggucuugugucacuacaauggcaaaggauaaacccaccuuggacaucgaacugcuaaagacugaggugacaaacccugccgugcucaggaaacugugcauugaagcuaagaucagcaauaccacgaccgauucccgguguccaacacaaggagaggccacucuugucgaagaacaagacgcaaacuuuguuugccgccgaaccuucguggauagaggcugggguaauggguguggacuguuuggcaaaggcucauugauaacaugcgcuaaguucaagugcguaacuaaacucgaggggaagauugugcaguacgaaaaccugaaauauagugucaucgugaccguucacacaggagaccagcaucaaguggguaaugagagcaccgaacacggcacuacggccacaauuacaccccaggcgccuucuacugagauccaguuaaccgacuacggggcccugacacucgauuguuccccaaggaccggacuugacuuuaacgaaaugguccuguugacuaugaaggagaaaucauggcuagugcauaagcagugguuccuggaucucccgcugcccuggacaagcggcgcaaguacgucucaagagaccuggaaucggcaggaccuucugguaacuuuuaaaacagcucacgccaagaagcaggaaguuguggucuuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugugauguguaccggaucuuucaaacucgagaaggaagucgcugagacacagcacgguacugugcugguucagauaaaguacgagggcaccgacgcgccuugcaaaaucccauuuuccacgcaagaugaaaagggggugacacagaacggacgccuuauuaccgcaaaucccaucguaacugacaaagagaagccugucaacauagaagccgagccacccuucggcgagucauauauugugaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguuuucacuagcguggggaaacugguccaucagauuuuuggaaccgcguacggcgugcuuuucucagguguaaguuggacaaugaagauagggaucggcgugcuguugacguggcucggacuaaauucccgaagcaccucuuuaucaaugacuuguauugcuguuggccuggucacacuauaccucggggugauggugcaggccgauaguggaugcgucaucaacuggaaaggccgcgaacugaagugugguagcgggaucuuuguuaccaaugaggugcacacauggacugaacaauauaaguuccaggcagacuccccgaaaagacuuucugccgcuauuggaaaggccugggaggagggcgugugcgguauaaggucggcaacccgguuggaaaacaucauguggaaacagauuagcaacgagcugaaucauauccuccuggaaaacgacaugaaguuuacgguagucgugggcgauguugcugggauuuuagcccagggcaagaagaugauccgcccucaacccauggaguacaaauauuccuggaagucauggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauaguuauacucaggugugcgaccaccguuugaugucugcagccauuaaagauagcaaggcuguucacgccgacaugggguacuggaucgaauccgagaaaaaugaaaccuggaagcucgcacgggcgucauucauugaggugaagacauguaucuggccaaaaagccauacgcuguggucuaacggaguacuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgucgugguggaugagcacugcgggaacagaggacccagcuugaggacuacaaccgucacgggcaagauuauccacgaaugguguugccgcucuuguacucugccuccauuacgguuuaaaggugaggacgggugcugguauggaauggagauaagacccguuaaggaaaaggaggaaaaucucgugaaauccaugguaucagcuggcaguggugagguggacagcuucucgcugggccuucuguguauuuccaucaugaucgaagaggucaugaggucucgcuggagccgaaagauguugaugaccgggacacucgccguguuuuuccugcuaauuaugggacagcugaccuggaacgaucucauccggcugugcauuaugguuggcgcaaaugcuucagaccguauggggaugggaaugacuuaccuugccuugauggcaacauuuaaaaugagaccuauguucgccgugggccuguuauuuaggcgccucaccagucgggagguccugcuucugacaauaggucuaucccucguggcuucuguugaacugccaaacagcuuggaggaacugggggauggauuagcgaugggcaucaugauucucaagcugcuuacugacuuccaaucccaucagcugugggccaccuugcucucacugacguuuaucaaaacaaccuucagccuacacuaugcauggaagacuauggcuauggugcugaguauugucucucuuuuuccccucugucuguccaccacaagccagaagacuaccugguugccgguacuguuaggcucgcucgggugcaaaccucugacgauguuccuuaucgccgagaauaagauauggggaagaaaaucauggccacugaacgaagguaucauggccgugggcauuguuucuaucuugcucaguucccugcuaaagaacgaugugccccuggcugggccucuuauugcaggaggcaugcucaucgccuguuacgucauaagcgguucuagcgcggaccuguccuuggagaaagcugccgaggugucaugggaagaggaagcagagcauaguggggccagccacaauauuuuaguagaagugcaggaugacggaacaaugaagaucaaagaugaggagagggacgauacccugacuauccuccugaaggcuacacuucuggcagucucuggcguuuaucccuuguccauuccagccacccuauucgugugguacuuuuggcaaaagaaaaagcagcgaucaggcgugcugugggacacuccuagucccccagaagucgagcgcgcggugcucgaugacgggauauaucggaucaugcagagaggacugcuugguaggagccagguuggcguagggguguuccaagaaaacgucuuucauacaauguggcacgugacccguggagcuguuuuaauguaccagggcaaacgccuggagccguccugggccucugugaagaaagaccucauuucguacggugggggauggcgguugcagggcagcuggaauacgggcgaggaaguccaggugaucgcaguagagccugggaagaaccccaagaauguccaaacugccccaggaaccuucaaaacaucagaaggugaggugggcgcuauugcccuggauuuuaagcccgggaccuccggaaguccuaucguuaacagagaaggcaaaauagugggucucuaugggaauggagucgugacaacuucuggcaccuacguuagcgcaaucgcucaggccaaggcgucccaggagggcccacugcccgagauugaagacgagguguucaggaaacgaaaccuuacgaucauggaucugcacccugggucaggaaagacacggcgcuauuugccggccauugucagagaagcaaucaagaggaaacuacggacucugauacucgcuccaacccgagugguagccucugagauggcugaagcauuaaaggguaugcccauuagauaccaaacaaccgccgugaaaagcgagcauacuggcaaggagaucguugaccugaugugccacgccaccuuuacaaugcgccuucugaguccugucagggugccaaauuauaacaugaucauuauggaugaagcucauuucacggaccccuccagcaucgcggcacguggguacauaucuacucgggugggaaugggcgaggccgcugccauuuuuaugaccgcaacaccuccggguucagucgaagccuucccccaguccaaugcuguaauccaggaugaggaaagagacauuccagagaggaguuggaacagcggguaugaguggaucaccgauuuuccuggaaaaacugugugguucguucccucgauaaagucuggcaaugacauugcgaacugucuccgcaagaauggcaaacgagugauccaguuguccagaaagacauucgauaccgaauaccagaagacgaagaacaacgacugggacuacgucgugacuacagauaucagcgagaugggggccaauuuucgggcagacaggguuauugauccacgccguugccugaaaccugugauccucaaggacggacccgaaagagucauucuggcugguccaaugccggugaccguagccucagcagcccagcggaggggccgcauagggcgaaaccacaauaaggagggagaucaguauaucuacaugggccagccucuuaacaaugacgaggaucaugcucacuggaccgaagccaaaaugcuacuggacaacauuaauacucccgaggguaucaucccagcguuguucgaacccgagagagaaaagagugcagccauugauggggaguaucgguuaaggggcgaggcucgcaaaacauuuguggaacugaugagaaggggagaccucccuguuuggcugucuuacaaggucgccuccgagggcuuccaauauagcgaucggcguuggugcuuugacggggaacgcaacaaucaggugcuugaggaaaacauggauguggagauauggaccaaagagggagaacgaaagaaacugagaccaagguggcucgacgcucggacauacucagaccccuuggcacugcgcgaguucaaggaauuugccgcugguagaaggagugucagcggcgaucuaauccuggagauugggaagcucccucagcaccuuacucagcgggcccaaaaugcacuggacaacuuaguuauguugcauaauuccgaacagggaggccgagcguauagacacgccauggaggagcugccggauacgaucgaaacccucaugcugcuugcucugauugccgugcucacaggugggguaacuuuguucuuucugucuggccgcggauuaggcaaaaccagcaucgggcuacugugugugauggcauccucaguccuccuuuggauggcuucuguggagccacauuggauagccgcaaguaucauucuggaguucuuuuugaugguucugcucauccccgagccugacaggcagcggacaccccaggauaaccaacuggccuacguggucauuggacuucucuucaugauccugaccguagcugcgaaugagauggguuugcuggaaacuacgaagaaagacuuaggcauagggcacguggccguugagaaccaccaucacgcagcuaugcuagauguggaccugcauccagccucggccuggacccucuacgcagucgcuacaacuauuaucaccccuaugaugcgucacacaauugaaaacaccacugccaauaucagccuuacagcgauagcuaaccaggccgcaauccugaugggauuggauaagggcuggcccauuuccaaaauggacaucggugugccacugcucgcccuggggugcuauucucaggucaauccucuuacguuaaccgcugcagugcugaugcucguugcccauuacgcgauuaucggcccgggauugcaagcuaaggccacuagagaggcacagaagaggacagccgcuggcauaaugaaaaaccccaccguggaugggauuguagccaucgaccuggauccaguggucuaugacgcaaaguuugaaaaacagcuaggacagaucaugcugcucauucuuuguaccucacaaauccuguugaugcgcacaacuugggcucugugcgagagcauaacgcucgccaccggcccucugacaacuuuaugggaggguucccccgggaaguucuggaauaccacaauugcgguuaguauggccaacaucuuccggggaucuuaccuugcaggcgcuggucuggccuuuagccucaugaaaucacuaggcgggggacgaagaggcaccggggcacagggagaaacucugggcgagaaguggaagaggcaguugaaucagcuguccaaaagugaguucaacacguauaagcgcagcgguauuauggagguggaccggucugaagcuaaagaggggcucaagagaggagagacaaccaaacacgccgucucccguggcacugccaaacuuaggugguuuguggaacggaaucugguaaagccagaggguaaagugaucgauuugggcugugggcgcggaggcuggucauacuauugcgcggggcugaagaaaguuaccgaagugaagggauacacaaaaggcgguccugggcacgaggaacccauaccgauggcuacuuacggauggaaccucgucaaguuacauagcggcaaagacguguucuuugucccaccugagaagugugauacccugcuuugcgacaucggcgagucgucucccaauccaacaauugaagaggggcgaacgcugagagugcuaaagaugguugaacccuggcucaggggaaaccaauucuguaucaaaauucugaauccuuauaugccgaguguaguggagaccuuggagcagaugcagcggaagcacgguggcaugcugguccgcaacccccucuccagaaauagcacucaugaaauguacugggugucaugcgggacaggaaacaucguuuccgcagugaauaugaccucuaggaugcuucugaaccgauuuacuauggcccaccggaaaccaacauaugagcgugaugucgacuuaggcgcugguaccagacacguggccguagaaccugagguggcaaaccuggauauuaucgggcagcgcauagaaaauauuaagcaugagcacaaaagcacguggcauuacgacgaggauaaccccuauaagaccugggccuaccacggaaguuaugaaguuaagccuuccggcagcgcuucuucaauggucaauggcguggugaaauugcucacaaagccaugggacgucauccccaugguuacucaaaucgcgaugaccgauacaacuccuuucgggcagcagaggguguuuaaagagaagguagacacccggacaccaaaagccaagagaggaaccgcacaaauuauggaagugacugcuaaguggcugugggguuuccuaagucgcaacaaaaagcccaggauauguacgcgagaggaauuuacacggaaagucagauccaaugccgcaaucggcgccguguucguugacgagaaccaguggaauagcgcuaaggaggccguggaagaugagagguuuugggaccuuguccaucgcgaacgugagcugcacaaacaggggaagugcgcgaccugcguguacaacaugaugggaaagcgggagaaaaagcucggcgaguucgguaaagcaaaggggucuagagccauuugguacauguggcugggagcuagguucuuggaguuugaagcccugggcuucaugaaugaggaucacugguuuucgcgcgaaaacucacucagcggcguagagggggagggacuucauaaacuggguuauaucuuacgagacauuuccaagaucaguggcgggaauauguacgcagaugacacugcuggaugggauacccggauaacagaagacgaucugcagaacgaggccaaaaucacggacauuauggaaccggagcacgcuuugcucgccaauucuaucuucaagcugaccuaucaaaacaagguugugagaguccagaggccugccaaaaauggcacugugauggaugugauuagccgcagagaccagcgggguuccgggcaggucggaacauacggccuaaacaccuuuacuaacauggaagcgcaacuuaucaggcagauggagucagagggcauauucaguccaucugaacuggagacacccaaucucgccgaacguguucuggauugguuggagaagcaugggguggaacgauuaaaacgcauggcuauuagcggagacgacuguguagugaagccuaucgaugacagauuugccaccgcacugacagcucucaacgauauggguaaaguccggaaggacaucccacagugggagcccuccaagggcuggaaugauuggcagcaagugccguucugcucacaccacuuucaucagcuuauuaugaaagacgggagggagauaguugugccuugucgcaaccaggaugaacuggucggcagagcacgggugagccagggagcagguuggucucuaagggagacugccugccuggggaaguccuaugcgcaaauguggcagcucauguacuuccaccgacgugacuugagacuggcugccaaugcaaucuguagugccguacccguugauugggugccaaccagccgcacgaccuggucgauucaugcucaccaucaguggaugacaacugaagacaugcuuuccgucuggaaccggguguggaucgaggaaaauccuuggauggaggauaaaacccacauuucuucaugggaggacguucccuaucugggaaagagggaagaccaauggugcggcagccucaucggcuuaacagccagagcaacuugggcuaccaacauacagguggccaucaaucagguccgccggcugauugggaacgagaauuacuuggauuacaugacgaguaugaaaagguuuaagaacgaauccgacccagagggagcgcugugguga

SEQ ID NO: 13310 - RNA, 9879 nt, Artificial Sequence
  derived and/or modified CDS sequence (opt3) from DENV-1__HM488255__SS-prME
agcgugaccaugcugcucaugcuuaugcccacugcacuggcuuuccacuugacuacgcggggaggggagccucauaugaucgucuccaagcaggaaaggggaaaaucuuuacuguuuaagaccucagccgguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagucggccuggaaacagauccagaggguggaaacuugggcucuccggcacccuggguucaccguuauugcacuguuucuggcccaugcuaucggaacaucaauuacccagaagggcaucauauucauccucuuaaugcuggugacgccaagcauggccaugcgcugcgucggcauugggagucgggauuuuguggagggacuuuccggugcgacuuggguagacguuguguuggagcacggcucuugugucacaaccauggcaaaggauaaacccacucuggacaucgaacuacucaagacagaggugaccaacccugccauucugaggaaacuuugcaucgaagcuaagauaagcaauacgaccacagauucccgguguccaacucaaggggaggccacccugguggaagaacaagacgcaaacuucgucugccgccgaacauuuguugauaggggauggggcaaugguuguggguuguucggaaaaggcucacucauuacuugcgcuaaguuuaagugcgugaccaaacuggagggcaagaucguacaguacgaaaacuuaaaauauagugugauugucacagugcacaccggggaccagcaucaaguuggaaaugagagcacugaacacgguacgacagccaccaucacuccccaggcgccuaccacagagauccagcugaccgacuacggcgcccucacucuugauuguucuccaaggacagggcuggacuucaacgaaaugguguugcuaacgaugaaggagaaauccuggcugguccauaagcagugguuucucgaucugccgcuucccuggaccucaggagcaagcacaagucaagagacauggaaucggcaggaccuguuggugaccuucaaaacagcucacgccaagaagcaggaaguaguugugcucggcucucaagagggugcuaugcacacugcccugaccggggcaacggaaauucagaccuccggcacaacuaccauauuugccggacauuuaaaaugccgucugaagauggauaaacuaacacucaagggcaugagcuaugucauguguacugggucguucaaacuggagaaggaaguggcugagacccagcacggaacgguccuugugcagaucaaguacgaggguacagacgcgccuugcaaaauuccauucucuacccaagaugaaaagggcguuacucagaacgggcgcuugaucacagcaaaucccauagugaccgacaaagagaagccuguaaacauugaagccgagccacccuuuggagaguccuauaucgucaucggcgcuggugaaaaagcccugaagcucucaugguucaagaaagggaguagcauuggcaagauguuugaggcaacugccagaggagcuaggcggauggccauccugggcgauaccgcaugggacuucggguccauuggagguguguuuacaucuguuggcaaacuugugcaucagauauucgggacggcguacggaguccuguuuagcggcgugucauggaccaugaagaucgguauugggguauugcucacuuggcugggcuuaaauagucgauccacaagccugucuaugaccuguaucgcugugggccuaguuacacucuaccugggcgucauggugcaggccgauucagggugcgugaucaacuggaaaggacgcgaacuuaaguguggcagugguauuuucgucacuaaugagguucacaccuggacggaacaauauaaguuucaggcagacagcccgaaaagauuguccgccgcuauagggaaggccugggaggagggagugugcggcaucaggucugcaacacggcuggaaaacauuauguggaaacagaucucgaacgagcucaaucauauucuguuagaaaacgacaugaaguucaccgugguagucggugauguggcuggcauccuggcccaggggaaaaagaugauacgcccucaacccauggaguacaaauauagcuggaaguccuggggaaaggcgaaaaucauuggcgccgacguucagaauacuaccuuuaucauugaugggccaaacacaccugaaugucccgacgaucagagagcuuggaauaucugggagguggaggacuacggauucggcauauuuacuaccaacauuuggcuuaaguugagggauucauauacacaggucugcgaccaccgucucaugagugcagccaucaaagauucuaaggcugugcacgccgacauggguuacuggauugaaagcgagaaaaaugaaacguggaagcuggcacgggcguccuucaucgagguuaagaccuguauauggccaaaaucacauacucuauggagcaacggggugcuggaaucugagaugaucauucccaagaucuauggaggcccuauuucccaacacaauuaccgaccagguuacuucacacagaccgccggcccguggcaucucgggaaacuggagcuugauuuugacuugugcgaaggaacuacaguagucguggaugagcacugcggcaacagagggcccagucugaggaccacgacugugaccggaaagaucauacacgaaugguguugccgcagcuguacauuaccuccacuccgguucagaggcgaggacgguugcugguaugggauggagauuaggcccgucaaagaaaaggaggaaaaucugguuaagucuaugguguccgcuggaucaggcgagguagacaguuuuagccuuggucuguuguguaucucgaucaugauugaagaggugaugcgcucccgauggucucggaaaaugcucaugaccggcacucuggccgucuuccuacugcucaucauggggcagcugacauggaacgaucuuauucguuugugcauaauggugggagcaaaugcuagcgacagaaugggcauggggaccacauaccuggccuuaauggcaacuuuuaagaugaggccuauguucgccguuggacuccuguuucgccggcuuaccucaagagaggugcugcuacucacgaucggccugaguuuggucgcuuccguggaacugccaaacucuuuagaggaacucggugaugggcuggcgaugggaauuaugauccuuaaacuguugacagacuuccaaagccaucagcucugggccacccugcuaucccugacuuuuauuaagaccacauucucacuucacuaugcauggaaaacuauggcuaugguucucagcaucgugagucuguuucccuugugucugucuaccacgucccagaagacaaccugguuaccgguccuccugggcagccuuggcugcaagccucugacuauguucuugauagccgagaauaaaaucugggggaggcgaucguggccacucaacgaaggaauuauggccguagguaucgugucaauucugcuaucuagucugcuuaagaacgauguuccccucgcuggcccucugaucgcagggggaauguugauagccuguuacgugauuuccggcagcucugcggacuuaagccuggagaaagcugccgaggucuccugggaagaggaagcagagcauucaggugccagucacaauauccucguggaaguacaggaugacgggacaaugaagaucaaagaugaggagcgcgacgauacccugacuauucuucugaaggcuacauugcuagcagugagcggagucuauccccugucuauaccagccacccucuuuguuugguacuucuggcagaagaagaagcagcgguccggcgugcugugggacacgccuucacccccagaaguggagagagcgguccuugaugacggcaucuauaggauuaugcagcguggguuacugggacgcagucagguggguguuggcguauuccaagaaaacguguuucauacuauguggcacgucaccagaggggcugugcucauguaccagggaaaaagauuggagccgagcugggccuccguuaagaaagaccugaucucuuacggcgguggguggaggcuccagggaucguggaauacaggcgaggaagugcaggucauugcaguggagccuggcaagaaccccaaaaauguacaaaccgccccagggacauucaagacucccgaaggagaggucggugcuaucgcccuggauuuuaagccuggcaccagcgggucaccaauagugaaccgagaaggaaaaaucguuggccuuuaugguaaugggguggucacgacauccggaacuuacgugagugcaauugcucaggccaaggcgucucaggagggcccccugccugagaucgaagacgagguuuuccggaaacgcaacuugaccauuauggaucuacacccgggcagcgggaagacaagaagguaucugccagccaucgugcgggaagcaauaaaacgaaagcucagaaccuuaauucuggcucccacucgcgucguggccuccgagauggcugaagcacuuaagggaaugccuaucagguaccaaaccacagccguaaaaucagagcauacggguaaggagaucguggaccugaugugccacgccacuuuuaccaugcgucucuugucuccaguucggguccccaauuauaacaugauuaucauggaugaagcucauuucacagacccuagcaguauagcggcaagaggcuacauuuccaccaggguggggaugggagaggccgcugccaucuuuaugacugcaacaccgcccggcagcguggaagccuucccacagucuaaugcugucauucaggaugaggaacgcgacaucccugagcgaucauggaacuccgguuaugaguggauaaccgauuuucccgggaaaacgguaugguucgugccaaguauuaagagcggaaaugacaucgcgaacugucugaggaagaauggcaagcggguuauccagcucucgaggaagacuuuugauacagaauaccagaaaaccaagaacaacgacugggacuacguggucaccacugauauuucugagaugggcgccaauuuccgcgcagaccgugugaucgauccuagacggugccugaaacccguuauucuuaaggacgggccagaaagggugauacuagcuggaccgaugccugucacaguggccuccgcagcccagcgccgagguagaaucggccggaaccacaauaaagagggggaucaguauauuuacaugggacagccccugaacaaugacgaggaucaugcucacuggaccgaagccaagauguuguuagacaacaucaauacaccagagggcaucauucccgcgcuguucgaaccugagagggaaaagagcgcagccauagauggugaguaucgccucagaggggaggcuaggaaaacuuuuguagaacugaugcggcguggcgaccuuccaguguggcugucauacaagguugccagugagggauuccaauauucugaucgccgauggugcuuugacggcgaaagaaacaaucagguccucgaggaaaacauggauguggagaucuggacgaaagagggggaaaggaagaaauugcggccccgcuggcuggacgcuagaaccuacuccgacccucuagcacugagggaguucaaggaauuugccgcuggacggcgaagcgugucaggugaucucauucuugagaucggcaaacugccgcagcacuuaacacagagagcccaaaaugcauuggacaaccuggucaugcuccauaauagugaacaaggcgggcgcgcguauaggcacgccauggaggagcugccagauacuauugaaacccuuaugcugcucgcuuugaucgccguucugacagggggugugaccuuauucuuucuaagcgggcggggccugggaaagacuuccauaggccuccuuuguguaauggcaucuagcgugcuguuguggauggcuuccgucgagccccauuggaucgccgcaucaauuauccuggaguucuuucucauggugcugcuuauuccugagcccgaccgucagagaacgccacaggauaaccaacucgccuacguugugaucgggcuguuguucaugauacugaccgucgcugcgaaugagaugggauuacuagaaacaacuaagaaagaccuggguauuggccacguagccguggggaaccaccaucacgcagcuaugcucgauguugaccuucauccugccucugccuggacccuguacgcaguggcuacaaccaucauuacucccaugaugaggcacacaaucgagaacacgaccgccaauauaaguuugacugcgaucgcuaaccaggccgcaauucugaugggacucgauaagggcuggccaaucucgaaaauggacauuggugucccucugcuugccuuagggugcuauagccaggugaauccgcugacacucaccgcugcagucuugaugcugguggcccauuacgcgaucauaggccccggacuacaagcuaaggccacccgcgaagcacagaaacggacagccgcuggcauuaugaagaacccaacuguugaugggaucguggccaucgaccuggauccuguaguguaugacgcaaaguuugagaaacagcucggacagauuaugcuucugaucuuguguacgucccaaauacugcucaugcgaaccacaugggcucugugcgaaucuauuacuuuagccaccggcccccuuacaacccugugggaggguucaccagggaaguucuggaauacuacgaucgcggucagcauggccaacauuuuuagaggauccuaccucgcaggcgcuggucuagccuucagucugaugaaaucuuugggcagggggcgccggggaacaggcgcacagggggagacccugggagaaaaguggaaaagacagcucaaucagcuuagcaagucagaguucaacacuuauaagcguuccggcaucauggaaguugacaggagugaggcuaaagaaggucugaagagaggggaaaccacaaaacacgccgugagccgcggaacugccaaguugcgaugguuugucgagagaaaucuggugaaaccugaaggcaagguaauagaucucgguuguggcagagggggauggucuuacuauugcgcgggcuuaaagaaagugaccgagguuaagggguacacaaaaggaggccccggucacgaggaaccgaucccaauggcuacguacggguggaaccuggugaaacuucauuccggaaaagacgucuucuuuauuccucccgaaaagugugauacccugcuaugcgacaucggcgagucaagcccaaaucccacuauugaggaaggccggacacuccgcgugcugaaaauggucgagccuugguugagagggaaccaauucuguaucaagauucugaauccguauaugcccucggugguugaaacccucgagcagaugcagaggaagcacggagguaugcuuguacgaaacccacugucucggaauaguacucaugagauguacuggguguccugcggcacagggaacaucgucagcgcagugaauaugaccucacguauguuacugaacagauuuacgauggcccaccgcaaaccuaccuaugaaagggauguugacuugggagcuggcacacggcacguggccgucgagcccgaaguggcaaaccucgauauaauuggucagagaaucgagaauaucaagcaugaacacaaauccacuuggcauuacgacgaggauaacccuuauaagaccugggccuaccacgggucuuaugagguaaaaccaagcggaagugcuuccagcauggugaauggcguugucaagcugcuaacaaagcccugggacgugauuccuauggugacucaaauagcgaugaccgauacaaccccauucggccagcagcgcgucuuuaaagaaaagguugacacuaggacgcccaaagccaagcgagggacagcacaaaucauggaggugaccgcuaaauggcuuuggggauuccugucucggaacaagaagccgagaauuuguacuagggaagaguuuacccgcaaaguacguucaaaugccgcaaucggugccguguucgucgacgaaaaccaguggaauagugcuaaggaggccguggaggaugaacgguuuugggaccucguucauagagagagggaacugcacaaacagggcaagugcgcgacaugcguguacaacaugauggggaaacgcgagaagaaguugggagaguucggcaaagcaaaggguucccgagccauuugguacauguggcugggggcucgguuucucgaguucgaggcccuuggauucaugaaugaagaucacugguuuagcagagagaacucucugucgggcgucgaaggcgagggguuacauaaacugggauauaucuugagggacauaucaaagaucccugguggcaauauguacgcagaugacacggcugggugggauacccgcauuacugaggacgaucuccagaacgaagccagaaucacagacauuauggagccagaacacgcucugcuagccaaaagcaucuucaaacuuaccuaucaaaauaaagugguacggguucagaggcccgcaaagaacggaacugugauggaugucauaucccgucgagaccagcgcggcaguggucagguggggacauacggacugaauaccuuuacaaacauggaggcgcaacucauuagacagauggaaucugagggcaucuucagcccuuccgagcuggaaacuccaaacuuggccgagcggguguuagauuggcuggaaaaguauggcgucgagaggcucaaacgcauggcuaucucaggggacgacuguguugugaagcccauugaugacagauuugccaccgcacuuacggcucugaaugauaugggaaaaguacggaaggacauaccgcagugggaaccuaguaaagguuggaacgauuggcagcaagugcccuucugcucucaucacuuucaccagcuaaucaugaaggacggcagggagauugucgugccaugucgaaaucaggaugagcugguugggcgugccagagugagccagggagcaggcuggucccuccgcgaaaccgccugcuuggguaagucauacgcgcaaauguggcagcugauguauuuccaucggagggaccuuagacuggcugccaacgcaaucuguagcgccgucccuguggauuggauucccacaucucgcacuaccugguccauccacgcucaucaccaguggaugacaacugaggacaugcucaguguauggaaucggguuuggauagaagagaacccauggauggaagauaaaacccauaucagcucguggggagacgugcccuacuuaggaaagagggaggaccaauggugcggcucccugauuggcuugacggcccgagcaacaugggcuaccaauauccaggucgccauuaaccaggugagacggcugaucgggaaugagaacuaccucgauuauaugacuucuaugaaaagguuuaagaaugaaucagacccugagggagcgcuuugguga

SEQ ID NO: 13311 - RNA, 9879 nt, Artificial Sequence
  derived and/or modified CDS sequence (opt3) from DENV-1__HM181944__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauaagugaagcggaaccggacgauguggacuguuggugcaaugcuacagauaccuggguaacuuaugggacauguagccaaaccggagagcaccgccgagacaagcguuccguggcccuugcaccccaugucggccuggguuuggagacgagaacugaaaccuggaugucuucggagggggccuggaaacagauccagaggguggaaacaugggcucuccggcacccuggauucacuguuauugcacuguuucuggcccaugcuaucggcaccucaauuacacagaagggcaucauauucauccucuuaaugcuggugaccccaagcauggccaugcgcugcgucgggauuggaaguagagauuuuguggagggucuuuccggcgcgacguggguagacguuguguuggagcacgggucuugugucacuacaauggcaaaggauaaacccacccuggacaucgaacuacucaagacugaggugacaaacccugccgugcugaggaaacuuugcauugaagcuaagaucagcaauaccacgaccgauucccgguguccaacacaaggagaggccacucuggucgaagaacaagacgcaaacuucguuugccgccgaaccuuuguggauagaggcugggguaauggguguggauuguucggcaaaggcucacucauaacaugcgcuaaguuuaagugcguaacuaaacuggaggggaagauugugcaguacgaaaacuuaaaauauagugucaucgugaccguucacacaggagaccagcaucaaguggguaaugagagcaccgaacacggcacuacggccacaauuacaccccaggcgccuucuacugagauccagcugaccgacuacggggcccucacacuugauuguuccccaaggaccggacuggacuucaacgaaauggucuugcuaacuaugaaggagaaaucauggcuggugcauaagcagugguuucucgaucugccgcuucccuggacaagcggcgcaaguacgucucaagagaccuggaaucggcaggaccuguugguaacuuucaaaacagcucacgccaagaagcaggaaguugugguccucgguucccaagagggggcuaugcacaccgcccugacaggcgcaacugaaauccagaccagcggaacgaccacaauuuuugccggccauuuaaaaugccgucugaagauggauaaacuaacucucaaggggaugucguaugugauguguaccggaucuuucaaacuggagaaggaagucgcugagacacagcacgguacugugcuuguucagauaaaguacgagggcaccgacgcgccuugcaaaaucccauucuccacgcaagaugaaaagggggugacacagaacggacgcuugauuaccgcaaaucccaucguaacugacaaagagaagccugucaacauagaagccgagccacccuuuggcgagucauauauugugaucggugcuggggaaaaagcccugaagcucaguugguucaagaaaggcagcuccaucggaaagauguuugaggcaacagccagaggcgcuaggcggauggccauucugggggauaccgcaugggacuucggaucuaucgguggcguuuuuacuagcguggggaaacuuguccaucagauuuucggaaccgcguacggcgugcuguuuucagguguaaguuggacaaugaagauagggaucggcguguugcucacguggcugggauuaaauucccgaagcaccucucugucaaugacuuguauugcuguuggccuagucacacucuaccugggggugauggugcaggccgauaguggaugcgucaucaacuggaaaggccgcgaacuuaagugugguagcgggaucuucguuaccaaugaggugcacacauggacugaacaauauaaguuucaggcagacuccccgaaaagauugucugccgcuauuggaaaggccugggaggagggcgugugcgguauaaggucggcaacccggcuggaaaacaucauguggaaacagauuagcaacgagcucaaucauauccuguuagaaaacgacaugaaguucacgguagucgugggcgauguugcugggauucuggcccagggcaagaagaugauccgcccucaacccauggaguacaaauauuccuggaagucauggggcaaggcgaaaauaaucggggccgacgugcagaauacaaccuuuauuaucgauggaccaaacacuccugaaugucccgacgaucagagagcuuggaauauuugggaggucgaggacuacggcuucgguaucuuuaccacaaacauauggcuuaaguugagggauaguuauacucaggugugcgaccaccgucucaugucugcagccauuaaagauagcaaggcuguucacgccgacaugggguacuggaucgaauccgagaaaaaugaaaccuggaagcuggcacgggcgucauucauugaggugaagacauguaucuggccaaaaagccauacgcuauggucuaacggaguacuggaauccgagaugauaauccccaagauuuauggcgguccuaucagucaacacaauuaccgaccaggcuacuucacccagacugccgggccguggcaucucggaaaacuggagcuugauuuugacuugugcgaaggcacaaccgucgugguggaugagcacugcgggaacagaggacccagccugaggacuacaaccgucacgggcaagauuauccacgaaugguguugccgcucuuguacuuuaccuccacuccgguucaaaggugaggacgggugcugguauggaauggagauaagacccguuaaggaaaaggaggaaaaucuggugaaauccaugguaucagcuggcaguggugagguggacagcuuuucgcuuggccuguuguguauuuccaucaugaucgaagaggucaugaggucucgcuggagccgaaagaugcucaugaccgggacacuggccguguucuuucuacugauuaugggacagcucaccuggaacgaucugauccggcuuugcauuaugguuggcgcaaaugcuucagaccguauggggaugggaaugacuuacuuggcccugauggcaacauucaaaaugagaccuauguuugccgugggcuuacucuucaggcgccugaccagucgggagguccuucugcuaacaauaggucucucccugguggcuucuguugaauugccaaacagccuggaggaauuaggggauggacucgcgaugggcaucaugauucugaaacuucugacugacuuucaaucccaucaguugugggccacccuccugucacuaacguucaucaaaacaaccuuuagccugcacuaugcauggaagacuauggcuauggugcuuaguauugucucucucuucccccuguguuuguccaccacaagccagaagacuaccuggcugccgguauuacucggcucgcuggggugcaaaccucuuacgauguuucugaucgccgagaauaagauauggggaagaaaaucauggccauugaacgaagguaucauggccgugggcauuguuucuauccuccugaguucccuacugaagaacgaugugccccuugcugggccucucauugcaggaggcaugcugaucgccuguuacgucauaagcgguucuagcgcggacuuguccuuagagaaagcugccgaggugucaugggaagaggaagcagagcauaguggggccagccacaauauucugguagaagugcaggaugacggaacaaugaagaucaaagaugaggagagggacgauacccucacuauccugcuuaaggcuacacuguuggcagucucuggcguuuauccccuauccauuccagccacccuguucgugugguacuucuggcaaaagaaaaagcagcgaucaggcgugcucugggacacuccuagucccccagaagucgagcgcgcggugcuggaugacgggauauaucggaucaugcagagaggacuuuuagguaggagccagguuggcguagggguguuucaagaaaacgucuuccauacaauguggcacgugacccguggagcuguucugauguaccagggcaaacgccucgagccguccugggccucugugaagaaagacuugauuucguacggugggggauggcggcugcagggcagcuggaauacgggcgaggaaguccaggugaucgcaguagagccugggaagaaccccaagaauguccaaacugccccaggaaccuuuaaaacaucagaaggugaggugggcgcuauugcccucgauuucaagcccgggaccuccggaaguccuaucguuaacagagaaggcaaaauagugggucuguaugggaauggagucgugacaacuucuggcaccuacguuagcgcaaucgcucaggccaaggcgucccaggagggcccacuucccgagauugaagacgagguguuuaggaaacgaaaccugacgaucauggauuugcacccugggucaggaaagacacggcgcuaucuaccggccauugucagagaagcaaucaagaggaaacugcggacucucauauuagcuccaacccgagugguagccucugagauggcugaagcacugaaggguaugcccauuagauaccaaacaaccgccgugaaaagcgagcauacuggcaaggagaucguugaccuuaugugccacgccaccuucacaaugcgccugcucaguccugucagggugccaaauuauaacaugaucauuauggaugaagcucauuuuacggaccccuccagcaucgcggcacguggguacauaucuacucgggugggaaugggcgaggccgcugccauuuucaugaccgcaacaccuccggguucagucgaagccuuuccccaguccaaugcuguaauccaggaugaggaaagagacauuccagagaggaguuggaacagcggguaugaguggaucaccgauuucccuggaaaaacugugugguuuguucccucgauaaagucuggcaaugacauugcgaacuguuugcgcaagaauggcaaacgagugauccagcuguccagaaagacauucgauaccgaauaccagaagacgaagaacaacgacugggacuacgucgugacuacagauaucagcgagaugggggccaauuuccgggcagacaggguuauugauccacgccguugccucaaaccugugauccugaaggacggacccgaaagagucauucuugcugguccaaugccggugaccguagccucagcagcccagcggaggggccgcauagggcgaaaccacaauaaggagggagaucaguauaucuacaugggccagccucuaaacaaugacgaggaucaugcucacuggaccgaagccaaaaugcuguuggacaacauuaauacucccgaggguaucaucccagcguuauuugaacccgagagagaaaagagugcagccauugauggggaguaucggcugaggggcgaggcucgcaaaacauucguggaacucaugagaaggggagaccugccuguuuggcuuucuuacaaggucgccuccgagggcuuucaauauagcgaucggcguuggugcuucgacggggaacgcaacaaucaggugcuggaggaaaacauggauguggagauauggaccaaagagggagaacgaaagaaacucagaccaaggugguuggacgcucggacauacucagacccccuggcacuacgcgaguuuaaggaguucgccgcugguagaaggagugucagcggcgaucugauccucgagauugggaaacuuccucagcaccugacucagcgggcccaaaaugcauuagacaacuugguuaugcugcauaauuccgaacagggaggccgagcguauagacacgccauggaggagcucccggauacgaucgaaacccugaugcuucuggcucucauugccguguugacaggugggguaacucuguuuuucuuaucuggccgcggacuaggcaaaaccagcaucgggcugcucugugugauggcauccucaguccuucuguggauggcuucuguggagccacauuggauagccgcaaguaucauuuuggaauuuuuccugaugguucuccugauccccgagccugacaggcagcggacaccccaggauaaccaacuugccuacguggucauuggacuccuguuuaugaucuugaccguagcugcgaaugagaugggucuguuagaaacuacgaagaaagaccuaggcauagggcacguggccguugagaaccaccaucacgcagcuaugcuggauguggaccuccauccagccucggccuggacccuuuacgcagucgcuacaacuauuaucaccccuaugaugcgucacacaauugaaaacaccacugccaauaucagccugacagcgauagcuaaccaggccgcaaucuugaugggacuggauaagggcuggcccauuuccaaaauggacaucggugugccacuccuggcccuugggugcuauucucaggucaauccuuuaacgcugaccgcugcagugcucauguugguugcccauuacgcgauuaucggcccgggacugcaagcuaaggccacuagagaggcacagaagaggacagccgcuggcauaaugaaaaaccccaccguggaugggauuguagccaucgaccuagauccaguggucuaugacgcaaaguucgaaaaacagcugggacagaucaugcuccuuauucuguguaccucacaaaucuugcugaugcgcacaacuugggcucucugcgagagcauaacgcuggccaccggcccuuuaacaacucuuugggaggguucccccgggaaguuuuggaauaccacaauugcgguuaguauggccaacaucuuccggggaucuuaccuggcaggcgcuggucucgccuucagccuaaugaaaucacugggcgggggacgaagaggcaccggggcacagggagaaacuuugggcgagaaguggaagaggcagcugaaucagcucuccaaaagugaauuuaacacguauaagcgcagcgguauuauggagguggaccggucugaagcuaaagaggggcuuaagagaggagagacaaccaaacacgccgucucccguggcacugccaagcugaggugguucguggaacggaauuugguaaagccagaggguaaagugaucgaucugggcugugggcgcggaggcuggucauacuauugcgcggggcucaagaaaguuaccgaagugaagggauacacaaaaggcgguccugggcacgaggaacccauaccgauggcuacuuacggauggaacuuagucaagcugcauagcggcaaagacguguuuuucgucccaccugagaagugugauacccuucugugcgacaucggcgagucgucucccaauccaacaauugaagaggggcgaacgcuaagagugcucaagaugguugaacccuggcugaggggaaaccaauuuuguaucaaaauuuugaauccuuauaugccgaguguaguggagacccuggagcagaugcagcggaagcacgguggcaugcucguccgcaacccccuuuccagaaauagcacucaugaaauguacugggugucaugcgggacaggaaacaucguuuccgcagugaauaugaccucuaggaugcuguuaaaccgauucacuauggcccaccggaaaccaacauaugagcgugaugucgaccugggcgcugguaccagacacguggccguagaaccugagguggcaaacuuggauauuaucgggcagcgcauagaaaauauuaagcaugagcacaaaagcacguggcauuacgacgaggauaaccccuauaagaccugggccuaccacggaaguuaugaaguuaagccuuccggcagcgcuucuucaauggucaauggcguggugaaacuccugacaaagccaugggacgucauccccaugguuacucaaaucgcgaugaccgauacaacuccuuuugggcagcagaggguguucaaagagaagguagacacccggacaccaaaagccaagagaggaaccgcacaaauuauggaagugacugcuaaguggcuaugggguuuucuuagucgcaacaaaaagcccaggauauguacgcgagaggaguucacacggaaagucagauccaaugccgcaaucggcgccguguuuguugacgagaaccaguggaauagcgcuaaggaggccguggaagaugagagguucugggaccugguccaucgcgaacgugagcuccacaaacaggggaagugcgcgaccugcguguacaacaugaugggaaagcgggagaaaaagcugggcgaguuugguaaagcaaaggggucuagagccauuugguacaugugguugggagcuagguuccuggaguucgaagcccucggcuuuaugaaugaggaucacugguucucgcgcgaaaacucacuuagcggcguagagggggagggacugcauaaauuagguuauauccugcgagacauuuccaagaucaguggcgggaauauguacgcagaugacacugcuggaugggauacccggauaacagaagacgauuugcagaacgaggccaaaaucacggacauuauggaaccggagcacgcucuccuggccaauucuaucuuuaagcuaaccuaucaaaacaagguugugagaguccagaggccugccaaaaauggcacugugauggaugugauuagccgcagagaccagcgggguuccgggcaggucggaacauacggccuuaacaccuucacuaacauggaagcgcaacugaucaggcagauggagucagagggcauauuuaguccaucugaacucgagacacccaaucuggccgaacguguuuuggauugguuagagaagcaugggguggaacgacugaaacgcauggcuauuagcggagacgacuguguagugaagccuaucgaugacagauucgccaccgcacucacagcucuuaacgauauggguaaaguccggaaggacaucccacagugggagcccuccaagggcuggaaugauuggcagcaagugccguuuugcucacaccacuuccaucagcugauuaugaaagacgggagggagauaguugugccuugucgcaaccaggaugagcuagucggcagagcacgggugagccagggagcagguuggucucugagggagacugccugccucgggaaguccuaugcgcaaauguggcaguugauguacuuucaccgacgugaccugagacuugcugccaaugcaaucuguagugccguacccguugauugggugccaaccagccgcacgaccuggucgauucaugcucaccaucaguggaugacaacugaagacaugcuguccgucuggaaccggguguggaucgaggaaaauccuuggauggaggauaaaacccacauuucuucaugggaggacguucccuaucucggaaagagggaagaccaauggugcggcagcuuaaucggccugacagccagagcaacuugggcuaccaacauacagguggccaucaaucagguccgccgguugauugggaacgagaauuaccuggauuacaugacgaguaugaaaagguucaagaacgaauccgacccagagggagcgcucugguga

SEQ ID NO: 13312 - RNA, 9879 nt, Artificial Sequence
  derived and/or modified CDS sequence (opt3) from DENV-1__HM181946__SS-prME
uccgugaccaugcugcucaugcuuaugcccacagcacuggcuuuccacuugacuacgagaggaggggagccucauaugaucgucuccaagcaggaaagaggaaaaucuuuacuguuuaagaccucagccgguguuaacaugugcacacugauugcaauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcacuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacuggaucguucaaacuggagaaggaaguggcugagacccagcacgguacgguccuugugcagauccgcuacgagggcacagacgcgccuugcaagauuccauucucgacccaagaugaaagagggguuacucagaacggaagguugaucacagcaaaucccauagugaccgacaaagagaagccuguaaacauugaagccgagccacccuuuggcgagucuuauaucgucaucggugcuggggaaaaagcccugaagcucuccugguucaaaaagggcucaaguauuggaaagauguuugaggcaacugcccggggcgcucgacgcauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucaagaaguacauccuucagcaugaccuguaucgcugugggccugguuacacuauaccucggggucauggugcaggccgauucuggaugcgugaucaacuggaaaggcagggaacugaagugugguucagggauuuuugucacuaaugagguucacaccuggacggaacaauauaaauuccaggcagacaguccgaagcggcuuagcgccgcuauaggaaaggccugggaggagggcgugugcgguauccgcuccgcaacaagauuggaaaacauuauguggaaacagaucucuaacgagcugaaucauauucuccuggaaaacgacaugaaguuuaccgugguagucggcgauguggcugggaucuuagcccagggcaagaagaugauaaggccucaacccauggaguacaaauauucguggcguagcuggggcaaggcgaaaaucauuggggccgacguucagaauacuaccuucaucauugauggaccaaacacaccugaaugucccgacgaucagcgggcuuggaauaucugggagguggaggacuacggcuuugguauauucacuaccaacauuuggcugaaacuucgagauuccuauacacaggucugcgaccacagauugaugucagcagccaucaaggauaguaaagcugugcacgccgacaugggguacuggauugaaucugagaagaaugaaacguggaaacucgcaagggcgagcuucaucgagguuaagaccuguauauggccaaaaucccauacucuguggucaaacggagugcuagaaagcgagaugaucauucccaagaucuauggcgguccuauuucucaacacaauuaccgcccaggcuacuuuacacagaccgccgggccguggcaucugggaaagcucgagcuggauuucgaccuuugcgaaggcacuacaguagucguggaugagcacugcgggaaccggggacccuccuugagaaccacgacugugaccggcaaaaucauacacgaaugguguugcaggaguuguacacugccuccauuacgcuuucgaggugaggacgggugcugguauggaauggagauucggcccgucaaggaaaaagaggaaaaucucguuaagagcauggugucugcuggcuccggugagguagacucauucagucugggccuucuguguaucagcaucaugauugaagaggugaugcguucgagaugguccaggaaaauguugaugaccgggacucucgccgucuuucugcuacugaucaugggacagcucacauggaacgaucugauucgccuuugcauaauggugggcgcaaaugcuucugaccggauggggaugggaaccacauacuuggcccugauggcaacuuucaagaugagaccuauguuugccguuggcuuacucuucaggcgacugaccagccgcgaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaaaaucuggggacggagaagcuggccauugaacgaagguauuauggccguaggcaucgugucgauucuccugucaucucuacugaagaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacaaugaaaaucaaggaugaggagagggacgauacccucacuauucugcuuaaagcuacacuguuggcagugaguggcgucuauccccuaagcauaccagccacccuguucguuugguacuucuggcaaaagaaaaagcagcguucuggcgugcucugggacacgccuucacccccagaaguggagcgcgcgguccuggaugacgggaucuaucggauuaugcagagaggacuuuuagguaggagccaggugggcguugggguauuucaagaaaacguguuccauacuauguggcacgucacccgaggagcugugcugauguaccagggcaaacggcucgagccgaguugggccagcguuaagaaggacuugaucuccuacggugggggauggcgccugcagggcucuuggaauacaggcgaggaagugcaggucauugcaguggagccugggaaaaaccccaagaauguacaaaccgccccaggaacauuuaaaacucccgaaggugaggucggcgcuaucgcccucgauuucaagccugggaccucgggaagcccaauagugaacagagaaggcaaaaucguuggucuguaugggaauggaguggucacgacaucaggcacuuacguguccgcaauugcucaggccaaggcgagucaggagggcccccuuccugagaucgaagacgagguuuuuaggaagcggaaccugaccauuauggauuugcacccggggucuggaaaaacacgaagauaucuaccagccaucgugcgcgaagcaauaaagaggaaacugcguacccucauuuuagcucccacucgggucguggccagcgagauggcugaagcacugaaggguaugccuaucagauaccaaaccacagccguaaaauccgagcauacgggcaaggagaucguggaccuuaugugccacgccacuuucaccaugaggcugcucucaccaguucgcguccccaauuauaacaugauuaucauggaugaagcucauuuuacagacccuucuagcauagcggcacgaggguacauuaguaccagagugggaaugggcgaggccgcugccaucuucaugacugcaacaccgcccgguuccguggaagccuuuccacagagcaaugcugucauucaggaugaggaacgggacaucccugagaggucuuggaacucaggguaugaguggauaaccgauuuccccggaaagacgguaugguuugugccauccauuaaaaguggcaaugacaucgcgaacuguuugcgcaagaauggcaaacguguuauccagcugagcagaaagacuuucgauacagaauaccagaagaccaagaacaacgacugggacuacguggucaccacugauauuucggagaugggggccaauuuccgggcagacagggugaucgauccucgccgaugccucaagcccguuauucugaaagacggaccagaaagagugauacuugcugguccgaugccugucacaguggccucugcagcccagcggaggggccgcaucgggagaaaccacaauaaggagggagaucaguauauuuacaugggccagccccuaaacaaugacgaggaucaugcucacuggaccgaagccaaaaugcuguuggacaacaucaauacaccagaggguaucauucccgcguuauuugaaccugagagggaaaaguccgcagccauagauggggaguaucggcugcguggcgaggcucgcaaaacuuucguagaacucaugcgaagaggagaccugccaguguggcuuagcuacaagguugccucagagggcuuucaauauagugauaggcgguggugcuucgacggggaacgcaacaaucagguccuggaggaaaacauggauguggagaucuggacgaaggagggagaaaggaagaagcucaggccccggugguuggacgcucgaaccuacucugacccucuggcacuaagagaguuuaaagaguucgccgcuggucgcagguccgugagcggcgaucugauucucgagaucgggaaacuuccgcagcaccugacacagcgggcccaaaaugcauuagacaacuuggucaugcugcauaauucagaacagggaggccgugcguauagacacgccauggaggagcucccagauacuauugaaacccugaugcuucuggcucucaucgccguuuugacagguggggugacccuguuuuucuuaaguggcaggggacuaggcaaaacuagcauagggcugcucuguguaauggcauccucugugcuucuguggauggcuagcgucgagccccauuggaucgccgcauccauuaucuuggaauuuuuccugauggugcuccugauuccugagcccgaccgccagcggacgccacaggauaaccaacuugccuacguugugaucggacuccuguuuaugauauugaccgucgcugcgaaugagaugggucuguuagaaacaacuaagaaagaccuaggcauugggcacguagccgugggaaaccaccaucacgcagcuaugcuggauguugaccuccauccugccucagccuggacccuuuacgcaguggcuacaaccaucauuacucccaugaugcgacacacaaucgagaacacgaccgccaauauaucucugacugcgaucgcuaaccaggccgcaauuuugaugggccuggauaaggguuggccaaucaguaagauggacauuggggucccucuccuggcccuuggcugcuauagccaggugaauccguuaacacugaccgcugcaguccucauguugguggcccauuacgcgaucauaggacccggccugcaagcuaaagccaccagagaagcacagaagaggacagccgcugggauuaugaaaaacccaacuguugauggaaucguggccaucgaccuagauccuguaguguaugacgcaaaguucgagaaacagcugggccagauuaugcuccuuauccuguguacgagccaaauauugcugaugcgcaccacaugggcucucugcgaauccauuacucuggccaccggucccuuaacaacccuuugggaggggucuccaggaaaguuuuggaauacuacgaucgcggucucaauggccaacauuuuccggggcagcuaccuggccggugcuggccucgccuucucccuaaugaagagucuagggggaggcagacgugggacaggagcacagggcgagaccuugggugaaaaauggaagaggcagcugaaucagcucucuaaaagcgaguuuaacacuuauaagcggucagggaucauggaaguugaccgcuccgaggcuaaagaaggacuuaagcgaggcgagaccacaaagcacgccgugaguagagguacugccaaacugaggugguucgucgagcggaauuuggugaagccugaaggcaaaguaauagaucugggguguggacgcggcggguggagcuacuauugcgcgggacucaagaaagugaccgagguuaagggcuacacaaagggugggcccggacacgaggaaccgaucccaauggcuacguacggcuggaacuuagugaaacugcauucuggcaaggacgucuuuuucgugccucccgaaaaaugugauacccuucugugcgacauuggggaguccucaccaaaucccacuaucgaggaaggaagaacacuaaggguccucaagaugguggagccuuggcugcgagguaaccaauuuuguauuaaaaucuugaauccguauaugcccagcguuguagaaacccuggagcagaugcagcggaagcacggcgggaugcucgugcguaacccacuuucgagaaauucuacucaugagauguacugggucaguugcggaacaggcaacauuguguccgcaguuaauaugaccagccgcaugcuguuaaacagguucacgauggcccaccggaaaccuaccuaugaaagagauguggaccugggugcugggacacgccacgucgccguggagcccgaaguagcaaacuuggauaucauaggacagaggauugagaauaucaagcaugaacacaagucaacuuggcauuacgacgaggauaacccuuauaaaaccugggccuaccacggcuccuaugaggugaagccaucuggcagcgcuaguuccaugguuaauggggucgugaaacuccugacaaagcccugggacgugaucccuauggucacucaaauugcgaugaccgauacaaccccauuuggacagcagcgaguuuucaaagaaaagguggacacucggacgcccaaggccaaaagagguacagcacaaauaauggagguaaccgcuaaguggcuauggggcuuucuuagcaggaacaaaaagccgcgcaucuguacucgugaagaguucacccggaaagugagaucuaaugccgcaauuggggccgucuuuguggacgaaaaccaguggaacucagcuaaggaggccguugaggaugaaagguucugggaccuggugcaucgcgagcgagaacuccacaagcagggaaaaugcgcgacaugcgucuacaacaugaugggcaagcgggagaaaaagcugggugaauuugggaaagcaaagggaaguagagccaucugguacaugugguugggcgcuagguuccuggaguucgaggcccucggcuuuaugaaugaagaucacugguucucccgcgagaacagccuuucugggguggaaggagagggucugcauaaguuaggcuauauucugagagacaucucgaaaauaccugggggaaauauguacgcagaugacacggcuggcugggauacccggaucacugaggacgauuugcagaacgaagccaggauuacagacaucauggagccagaacacgcucuccuggccaagucaauuuuuaaacuaaccuaucaaaauaagguaguucgugugcagcgacccgccaaaaaugguacugucauggaugugaucagccgcagagaccagcggggguccggacaggugggcacauacggccuuaauaccuucacaaacauggaggcgcaacugauaaggcagauggaaagugaggggauauuuucuccuagcgagcucgaaacuccaaaccuggccgagcgcgucuuggauugguuagaaaaguauggaguugagagacugaaacggauggcuaucuccggugacgacugugugguaaagcccaucgaugacagguucgccaccgcacucacggcucuuaaugauaugggcaaggugcgaaaagacauuccgcagugggaaccuucaaagggguggaacgauuggcagcaaguccccuuuugcagucaucacuuccaccagcugauaaugaaagacggacgugagaucgugguuccauguagaaaucaggaugagcuagugggccgcgcccgggucucucagggugcaggguggagccugagggaaaccgccugccucggaaaguccuacgcgcaaauguggcaguugauguauuuucauagacgcgaccugcggcuugcugccaacgcaauuuguucagccgugccuguagauuggauccccacaagcaggacuaccuggucuauucacgcucaucaccaguggaugacaacugaggacaugcuguccguuuggaaucgaguguggaucgaagagaacccauggauggaagauaaaacccauauaaguagcuggggcgacguccccuaccucggcaagagagaggaccaauggugcgggucguuaaucggacugacggcccgggcaacaugggcuaccaauauucagguggccaucaaccagguuaggcgcuugauugguaaugagaacuaccuggauuauaugacuuccaugaagcguuucaaaaaugaaucugacccugagggcgcgcucugguga

SEQ ID NO: 13313 - RNA, 9879 nt, Artificial Sequence
  derived and/or modified CDS sequence (opt3) from DENV-1__HM181948__SS-prME
agcgugaccaugcugcucaugcuuaugcccacagcccuggcuuuccacuugacuacgagaggaggggagccucauaugaucgucuccaagcaagaaagaggaaaaucuuuacuguuuaagaccucagccgguguuaauaugugcacauugauugccauggaccucggcgagcugugugaagauacuaugaccuacaaaugcccacggauaacagagguggaaccggacgauguggacuguuggugcaaugcgaccgauacuugggugacauaugggaccuguagucaaacgggagagcaccgccgagacaagcguagcgucgcucuugcaccccaugugggccuggguuuggagacuagaaccgaaacauggauguccucugagggggcauggaaacagauccagaggguugaaacuugggcccuccggcacccuggauucaccgugauugcucuguuucuggcacaugccaucggcacaucgauuacccagaagggcaucauauucauccucuuaaugcuggucacgccaucaauggcuaugcgcugcguggggauuggaagcagagauuuuguagagggucuuaguggcgccacuuggguugacguggucuuggagcacggguccugugugacaaccauggcgaaggauaaacccacucuggacaucgaacuacucaagacagaggugaccaacccugcaauucugaggaaacuuugcaucgaagccaagauaucuaauacgaccacagauagccgguguccaacucaaggagaggcuacccuggucgaagaacaagacgccaacuucguuugccgccgaacauuuguggauagaggcugggguaauggguguggauuguucggcaaaggcucccucauuacuugcgcaaaguuuaagugcguaaccaaacuggaggggaagaucgugcaguacgaaaacuuaaaauauucagucauugugacaguucacaccggagaccagcaucaaguggguaaugagaguacugaacacggcacgacagcuaccaucacuccccaggccccuaccacagagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauucagaccucuggaacaacuaccauauuugcaggccauuuaaaaugccgucugaagauggauaaacuaacacucaaggggauguccuaugugauguguacugguagcuucaaacuggagaaggaagucgccgagacccagcacggaacggugcuuguucagaucaaguacgagggcacagacgcuccuugcaaaauuccauucucgacccaagaugaaaagggggugacucagaacggacgcuugaucacagcgaaucccauaguaaccgacaaagagaagccugucaacauugaagcagagccacccuuuggcgagucuuauaucgugaucggugccggggaaaaagcucugaagcucuccugguucaagaaaggcucaaguauuggaaagauguuugaggccacugcaagaggcgccaggcggauggcuauccugggggauaccgccugggacuucggaagcauugguggcguuuuuacauccguggggaaacuuguccaucagauauucggaacggcauacggcgugcuguuuucugguguaagcuggaccaugaagaucgggauuggcguguugcucacuuggcugggauuaaauucacgaaguacaucccugagcaugaccuguaucgcgguuggccuagucacacucuaccugggggugauggugcaggcugauucuggaugcgucaucaacuggaaaggccgcgaacuuaagugugguucagggauuuucguuacuaaugaggugcacaccuggacggaacaauauaaguuucaggccgacaguccgaaaagauugagcgcagccauaggaaaggcuugggaggagggcgugugcgguaucagguccgccacacggcuggaaaacauuauguggaaacagaucucuaacgagcucaaucauauucuguuagaaaacgacaugaaguucaccguagucgugggcgauguugcagggauccuggcucagggcaagaagaugauacgcccucaacccauggaguacaaauauucguggaaaagcuggggcaaggccaagaucauuggggcggacgugcagaauacuaccuuuaucauugauggaccaaacacaccugaaugucccgacgaucagagagccuggaauaucugggaggucgaggacuacggcuucgguauauuuacuaccaacauuuggcuuaaguugagggauuccuauacacaggugugcgaccaccgucucaugucagcugcaaucaaagauaguaaggccguucacgcugacaugggguacuggauugaaucugagaaaaaugaaacguggaagcuggcccgggcauccuucaucgaggugaagaccuguauauggccaaaaucccauacucuauggucaaacggaguacuggaaagcgagaugaucauucccaagaucuauggcgguccuauuucucaacacaauuaccgaccaggcuacuucacacagaccgcggggccguggcaucucggaaaacuggagcuugauuuugacuugugcgaaggcacuacagucgugguggaugagcacugcgggaacagaggacccucccugaggaccacgacugucaccggcaagaucauacacgaaugguguugccgcaguuguacauuaccuccacuccgguucagaggugaggacgggugcugguauggaauggagauuaggcccguuaaagaaaaggaggaaaaucugguaaagagcaugguaucugccggcuccggugagguggacucauuuagucuuggccuguuguguaucagcaucaugauugaagaggucaugcgcucgcgauggucccggaaaaugcucaugaccgggacucuggcuguguuccuacugcucaucaugggacagcugacauggaacgaucuuauucguuugugcauaaugguuggcgccaaugcaucugacagaauggggaugggaaccacauaccuggcuuuaauggccacuuuuaagaugaggccuauguucgcagugggccuccuguuucgccggcuuaccagcagagagguccugcuacucacgaucggucugucauugguggccaguguugaacugccaaacuccuuagaggaacucggggauggacuggcuaugggcauuaugauccuuaaacuguugacagacuuccaaucucaucagcucugggcgacccugcuaagccugacuuuuauuaagaccacauucucccuucacuaugccuggaaaacuauggcaauggugcucucaaucgucagccuguuucccuugugucugaguaccacgucucagaagacaaccugguuaccgguacuccugggcucccuugggugcaagccucugacuauguucuugauagcugagaauaaaaucuggggaaggcgaagcuggccacucaacgaagguauuauggccgugggcaucguuucgauucugcuaucaucucugcuuaagaacgaugugccccucgccgggccucugaucgcuggaggcauguugauagcauguuacgucauuagugguuccagcgccgacuuaucucuggagaaagcggcugaggugagcugggaagaggaagccgagcauuccggggcaucacacaauauccucguagaagugcaggaugacggaacaaugaagaucaaagaugaggagcgcgacgauacccugacuauucuucugaaggccacauugcuagcugucaguggcguuuauccccugagcauaccagcaacccucuuugugugguacuucuggcagaagaagaagcagcggucuggcgugcugugggacacgccuucacccccagaagucgagagagccgugcuugaugacgggaucuauaggauuaugcagcguggauuacugggucgcagccagguuggcguagggguguuccaagaaaacgucuuucauacuauguggcacgugacccggggagcgguucucauguaccagggcaaaagauuggagccgaguugggcuagcgugaagaaagaccugaucuccuacggugggggauggaggcuccagggcucuuggaauacaggcgaggaaguccaggugauugccguagagccugggaagaaccccaaaaauguccaaaccgcaccaggaacauucaagacucccgaaggugaggugggcgccaucgcucuggauuuuaagccugggaccucgggaagcccaauaguuaaccgagaaggcaaaaucgugggucuuuaugggaauggagucgugacgacaucaggcacuuacguuuccgccauugcacaggcuaaggccagucaggagggcccccugccugagaucgaagacgagguguuccggaaacgcaacuugaccauuauggaucuacacccggggucuggaaagacaagaagguaucugccagcgaucguccgggaagccauaaaacgaaagcucagaaccuuaauucuggcacccacucgcgugguagcuagcgagauggccgaagcucuuaaggguaugccuaucagguaccaaaccacagcagugaaauccgagcauacgggcaaggagaucguugaccugaugugccacgccacuuuuaccaugcgucucuugucaccaguccgggugcccaauuauaacaugauuaucauggaugaagcccauuucacagacccuucuagcauagcugcgagaggguacauuaguaccagggugggaaugggcgaggcagccgcuaucuuuaugacugccacaccgcccgguuccgucgaagcauucccacagagcaaugccguaauucaggaugaggaacgcgacaucccugagcgaucuuggaacucaggguaugaguggauaaccgauuuucccggaaaaacggugugguucguuccauccauuaagaguggcaaugacaucgcuaacugucugaggaaaaauggcaagcgggugauccagcucagcaggaagacuuuugauacagaauaccagaaaaccaagaacaacgacugggacuacgucgugaccacugauauuucggagaugggggcgaauuuccgcgccgaccguguuaucgauccuagacggugccugaaacccgugauucuuaaggacggaccagaaagggucauacuagcagguccgaugccugugacaguagcuucugccgcacagcgccgaggcagaaucgggcggaaccacaauaaagagggagaucaguauauuuacaugggccagccccugaacaaugacgaggaucaugcccacuggaccgaagcuaagauguuguuagacaacaucaauacaccagaggguaucauucccgcccuguucgaaccugagagggaaaaguccgcggcaauagauggggaguaucgccucagaggcgaggccaggaaaacuuuuguggaacugaugcggcguggagaccuuccaguuuggcugagcuacaaggucgcuucagagggcuuccaauauagugaucgccgauggugcuuugacggggaaagaaacaaucaggugcucgaggaaaacauggauguggagaucuggacgaaagagggagaaaggaagaaauugcggccccgcuggcuggacgccagaaccuacucugacccucuagcucugagggaguucaaggaauuugcagccggucggcgauccgucagcggcgaucucauucuugagaucgggaaacugccgcagcacuuaacacagagagcucaaaaugccuuggacaaccugguuaugcuccauaauucagaacagggaggccgcgcauauaggcacgcgauggaggagcugccagauacuauugaaacccuuaugcugcucgccuugaucgcugugcugacaggugggguaaccuuauucuuucuaaguggccggggacugggcaagacuagcauagggcuccuuugugugauggccuccucuguccuguuguggauggcaagcguggagccccauuggaucgcugccuccauuauccuggaguucuuucucaugguucugcuuauuccugagcccgaccgucagagaacgccacaggauaaccaacucgcauacguggucaucggacuguuguucaugauacugaccguagccgcuaaugagauggguuuacuagaaacaacuaagaaagaccugggcauugggcacguggcgguuggaaaccaccaucacgccgcaaugcucgauguggaccuucauccugcuucagccuggacccuguacgccgucgcaacaaccaucauuacucccaugaugaggcacacaaucgagaacacgaccgcuaauauaucuuugacugccaucgcgaaccaggcugccauucugaugggccucgauaaggguuggccaaucaguaaaauggacauuggggugccucugcuugcauuaggcugcuauucgcaggucaauccgcugacacucaccgccgcuguguugaugcugguugcacauuacgccaucauaggacccggccuacaagcgaaggcuacccgcgaagcccagaaacggacagcagccgggauuaugaagaacccaacuguggauggaaucguagcuaucgaccuggauccuguggucuaugacgccaaguuugagaaacagcucggccagauuaugcuucugaucuuguguacgagccaaauacugcucaugcgaaccacaugggcacugugcgaauccauuacuuuagcuaccgguccccuuacaacccugugggaggggucuccaggaaaguucuggaauacuacgaucgccguuucaauggcgaacauuuuuagaggcagcuaccucgccggugcaggccuagcuuucucccugaugaaaagucuagggggaggcaggcgcgggacaggagcccagggcgagacccugggugaaaaguggaaacggcagcucaaucagcuuucuaagagcgaguucaacacuuauaagagaucagggaucauggaaguggaccguuccgaggcaaaagaaggacugaagaggggcgagaccacaaaacacgcugucagucgggguacugccaaguugcgcugguuuguggagcgaaaucugguaaaaccugaaggcaaggugauagaucucggguguggaagaggcggguggagcuacuauugcgccggauuaaagaaaguuaccgaggugaagggcuacacaaaaggugggcccggacacgaagaaccgaucccaauggcgacguacggcuggaaccuggucaaacuucauucuggcaaagacguguucuuuauuccucccgaaaagugugauacccugcuaugcgacaucggggaguccucaccaaaucccacuauugaggaaggaaggacacuccggguccugaaaaugguggagccuugguugcgcgguaaccaauucuguaucaagauucugaauccguauaugcccagcguuguagaaacccucgagcagaugcagagaaagcacggcgggaugcuugugaggaacccacugucgcgaaauucuacucaugagauguacugggucaguugcggaacaggcaacaucguguccgcuguuaauaugaccagccggauguuacugaaccguuuuacgauggcacacagaaaaccuaccuaugaacgcgauguggacuugggugccgggacaaggcacgucgcuguggagcccgaaguagccaaccucgauauaauuggacagcggaucgagaauaucaagcaugaacacaaaucaacuuggcauuacgacgaggauaacccuuauaagaccugggcauaccacggcuccuaugaggugaaaccaucuggcagcgccaguuccaugguuaauggggucgugaagcugcuaacaaagcccugggacgugauuccuauggucacucaaauagcuaugaccgauacaaccccauucggacagcagagaguuuuuaaagaaaagguggacacucgcacgcccaaagcgaagagggguacagcccaaaucauggagguaaccgcaaaauggcuuuggggcuuccugagccgaaacaagaagccgcggauuuguacuagagaagaguuuaccaggaaagugcgcucuaaugcugccaucggggcagucuucguggacgaaaaccaguggaacucagccaaggaggcuguugaggaugaacguuuuugggaccucgugcaucgggagagagaacugcacaaacagggaaagugcgccacaugcgucuacaacaugaugggcaaaagggagaagaaguugggugaguucgggaaagcgaagggaagucgcgcaauuugguacauguggcugggcgcccgauuucucgaguucgaggcucuuggcuucaugaaugaagaucacugguuuucccgggagaacagccugucugggguggaaggagaggguuuacauaaacugggcuauaucuugagagacauaucgaagaucccugggggaaauauguacgccgaugacacggcaggcugggauaccaggauuacugaggacgaucuccagaacgaagcucgcaucacagacauuauggagccagaacacgcccugcuagcuaaaucaaucuucaaacuuaccuaucaaaauaaaguaguuagagugcagcggcccgccaagaacgguacugucauggaugugauaagcaggcgugaccagcgaggguccggacaggugggcacauacggccugaauaccuuuacaaacauggaggcacaacucauucgccagauggaaagugaggggaucuucucuccuagcgagcuggaaacuccaaacuuggcggagagagucuuagauuggcuggaaaaguauggaguugagcggcucaaaaggauggccaucuccggugacgacugugugguaaagcccauugaugaccgcuuugcuaccgcccuuacggcacugaaugauaugggcaaagugagaaaggacauaccgcagugggaaccuucaaaaggguggaacgauuggcagcaaguccccuucugcagucaucacuuucaccagcuaaucaugaaggacggacgggagauugugguuccauguaggaaucaggaugagcuggugggccgagcucgugucucucagggugccggguggagccucagagaaaccgcaugcuugggaaaguccuacgcccaaauguggcagcugauguauuuccaucgccgggaccuuaggcuggcggcuaacgccaucuguucagcagugccuguagauuggauucccacaagcagaacuaccuggucuauccacgcccaucaccaguggaugacaacugaggacaugcucuccguuuggaaucgcguguggauagaagagaacccauggauggaagauaaaacccauaucaguagcuggggcgacguccccuacuuaggcaagcgggaggaccaauggugcgggucgcugauuggauugacggcuagggccacaugggcaaccaauauccagguggcuauuaaccagguucgaagacugaucgguaaugagaacuaccucgauuauaugacuuccaugaaacgguuuaagaaugaaucugacccugagggcgcccuuugguga

SEQ ID NO: 13314 - RNA, 9879 nt, Artificial Sequence
  derived and/or modified CDS sequence (opt3) from DENV-1__HM181949__SS-prME
agcgugaccaugcugcucaugcuuaugcccacagcacuggcuuuccacuugacuacgcggggcggggagccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguuccguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacuggccacgggacgacagccaccaucacuccccaggcgccuaccacagaaauccagcugaccgacuacggagcccucacucuugauuguagcccaaggacaggccuggacuucaacgagaugguguugcuaacgaugaaggaaaaaucuuggcugguccauaagcagugguuucucgaucugccgcuucccuggaccuccggugcaucaacuagccaagagacauggaaucggcaggaccuguuggugaccuucaaaacagcucacgccaagaagcaggagguaguugugcucgggagucaagaaggcgcuaugcacacugcccugaccggagcaacggagauucagaccucuggcacaacuaccauauuugccgggcauuuaaaaugccgucugaagauggauaaacuaacacucaagggaauguccuaugucauguguacugguagcuucaaacuggaaaaggagguggcugaaacccagcacggcacgguccuugugcagaucaaguacgaggggacagacgcgccuugcaaaauuccauucucgacccaagaugagaagggaguuacucagaacggccgcuugaucacagcaaaucccauagugaccgacaaagaaaagccuguaaacauugaggccgaaccacccuuuggugagucuuauaucgucaucggggcuggcgagaaagcccugaagcucuccugguucaagaaaggaucaaguauuggcaagauguuugaagcaacugccagaggggcuaggcggauggccauccugggagauaccgcaugggacuucgguagcauuggcgggguguuuacauccguuggaaaacuugugcaucagauauucggcacggcguacgguguccuguuuucuggggugagcuggaccaugaagaucggcauuggaguauugcucacuuggcugggcuuaaauucacgaaguacaucccugagcaugaccuguaucgcuguggggcuaguuacacucuaccugggagucauggugcaggccgauucuggcugcgugaucaacuggaaaggucgcgagcuuaagugugggucaggaauuuucgucacuaaugaaguucacaccuggacggagcaauauaaguuucaggcagacaguccgaaaagauugagcgccgcuauaggcaaggccugggaagagggugugugcggcaucagguccgcaacacggcuggagaacauuauguggaaacagaucucuaacgaacucaaucauauucuguuagagaacgacaugaaguucaccgugguagucggggauguggcuggaauccuggcccagggcaaaaagaugauacgcccucaacccauggaauacaaauauucguggaaaagcugggggaaggcgaagaucauuggagccgacguucagaauacuaccuuuaucauugauggcccaaacacaccugagugucccgacgaucagagagcuuggaauaucugggaaguggaggacuacgguuucgggauauuuacuaccaacauuuggcuuaaguugagggauuccuauacacaggucugcgaccaccgucucaugucagcagccaucaaagauaguaaggcugugcacgccgacaugggauacuggauugagucugagaagaaugagacguggaagcuggcacgggcgagcuucaucgaaguuaagaccuguauauggccaaaaucccauacucuauggucaaacggcgugcuggagagcgaaaugaucauucccaagaucuaugguggcccuauuucucaacacaauuaccgaccaggguacuucacacagaccgccggaccguggcaucucggcaaacuggagcuugauuuugacuugugcgaggggacuacaguagucguggaugaacacugcggaaacagaggccccucccugaggaccacgacugugaccgguaagaucauacacgagugguguugccgcaguuguacauuaccuccacuccgguucagaggggaagacggaugcugguauggcauggagauuaggcccgucaaagagaaggaagagaaucugguuaagagcauggugucugcugguuccggcgaaguagacucauuuagucuugggcuguuguguaucagcaucaugauugaggaagugaugcgcucgcgauggucccggaaaaugcucaugaccggaacucuggccgucuuccuacugcucaucaugggccagcugacauggaacgaucuuauucguuugugcauaauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgaucgggcugucauuggucgcuaguguggagcugccaaacuccuuagaagaacucggagauggccuggcgaugggcauuaugauccuuaaacuguugacagacuuccaaucucaucagcucugggccacccugcuaagccugacuuuuauuaagaccacauucucccuucacuaugcauggaaaacuauggcuaugguucucucaaucgugagccuguuucccuugugucugaguaccacgucucagaagacaaccugguuaccgguccuccuggggucccuuggaugcaagccucugacuauguucuugauagccgaaaauaaaaucugggguaggcgaagcuggccacucaacgagggcauuauggccguagggaucgugucgauucugcuaucaucucugcuuaagaacgauguuccccucgcuggaccucugaucgcaggcgguauguugauagccuguuacgugauuaguggguccagcgcggacuuaucucuggaaaaagcugccgaggucagcugggaggaagaggcagaacauuccggagccucacacaauauccucguggagguacaggaugacggcacaaugaagaucaaagaugaagaacgcgacgauacccugacuauucuucugaaggcuacauugcuagcagugaguggcgucuauccccugagcauaccagccacccucuuuguuugguacuucuggcagaagaagaagcagcggucuggggugcugugggacacgccuucacccccagagguggaaagagcgguccuugaugacggaaucuauaggauuaugcagcgugguuuacugggccgcagccagguggggguuggaguauuccaagagaacguguuucauacuauguggcacgucacccggggcgcugugcucauguaccaggguaaaagauuggaaccgaguugggccagcguuaagaaagaccugaucuccuacgggggaggcuggaggcuccagggcucuuggaauacaggggaggaggugcaggucauugcaguggaaccuggaaagaaccccaaaaauguacaaaccgccccagguacauucaagacucccgagggcgaagucggggcuaucgcccuggauuuuaagccuggaaccucgggcagcccaauagugaaccgagaggguaaaaucguugggcuuuauggaaauggcguggucacgacaucaggcacuuacguguccgcaauugcucaggccaaggcgagucaggaagggccccugccugagaucgaggacgaaguuuuccggaaacgcaacuugaccauuauggaucuacacccgggaucugguaagacaagaagguaucugccagccaucgugcgggaggcaauaaaacgaaagcucagaaccuuaauucuggcucccacucgcgucguggccagcgaaauggcugaggcacuuaagggcaugccuaucagguaccaaaccacagccguaaaauccgaacauacggggaaggagaucguggaccugaugugccacgccacuuuuaccaugcgucucuugucaccaguucggguccccaauuauaacaugauuaucauggaugaggcucauuucacagacccuucuagcauagcggcaagaggauacauuaguaccagggugggcaugggugaagccgcugccaucuuuaugacugcaacaccgcccggguccguggaggccuucccacagagcaaugcugucauucaggaugaagaacgcgacaucccugaacgaucuuggaacucaggauaugaguggauaaccgauuuucccggcaaaacgguaugguucgugccauccauuaagaguggcaaugacaucgcgaacugucugaggaaaaaugggaagcggguuauccagcucagcaggaagacuuuugauacagaguaccagaaaaccaagaacaacgacugggacuacguggucaccacugauauuucggaaaugggagccaauuuccgcgcagaccgugugaucgauccuagacggugccugaaacccguuauucuuaaggacgguccagagagggugauacuagcuggcccgaugccugucacaguggccucugcagcccagcgccgagggagaaucggacggaaccacaauaaagaaggcgaucaguauauuuacaugggucagccccugaacaaugacgaggaucaugcucacuggaccgaggccaagauguuguuagacaacaucaauacaccagaagggaucauucccgcgcuguucgagccugaaagggagaaguccgcagccauagauggcgaauaucgccucagaggagaggcuaggaaaacuuuuguagagcugaugcggcguggcgaccuuccaguguggcugagcuacaagguugccucagaaggguuccaauauagugaucgccgauggugcuuugacggagagagaaacaaucagguccucgaagagaacauggauguggaaaucuggacgaaagagggugagaggaagaaauugcggccccgcuggcuggacgcuagaaccuacucugacccucuagcacugagggaguucaaggaguuugccgcuggccggcgauccgugagcggggaucucauucuugaaaucggaaaacugccgcagcacuuaacacagagagcccaaaaugcauuggacaaccuggucaugcuccauaauucagagcagggcggucgcgcguauaggcacgccauggaggaacugccagauacuauugagacccuuaugcugcucgcuuugaucgccguucugacagggggcgugaccuuauucuuucuaaguggacggggccuggggaagacuagcauaggacuccuuuguguaauggcauccucugugcuguuguggauggcuagcgucgaaccccauuggaucgccgcauccauuauccuggaguucuuucucauggugcugcuuauuccugaacccgaccgucagagaacgccacaggauaaccaacucgccuacguugugaucggucuguuguucaugauacugaccgucgcugcgaaugagaugggcuuacuagagacaacuaagaaagaccuggggauuggacacguagccgugggcaaccaccaucacgcagcuaugcucgauguugaccuucauccugccucagccuggacccuguacgcaguggcuacaaccaucauuacucccaugaugaggcacacaaucgaaaacacgaccgccaauauaucuuugacugcgaucgcuaaccaggccgcaauucugaugggucucgauaagggguggccaaucaguaaaauggacauuggcgucccucugcuugccuuaggaugcuauucgcaagugaauccgcugacacucaccgcugcagucuugaugcugguggcccauuacgcgaucauaggccccgggcuacaagcuaaggccacccgcgaggcacagaaacggacagccgcuggaauuaugaagaacccaacuguugauggcaucguggccaucgaccuggauccuguaguguaugacgcaaaguuugaaaaacagcucggucagauuaugcuucugaucuuguguacgagccaaauacugcucaugcgaaccacaugggcucugugcgaguccauuacuuuagccaccgggccccuuacaacccugugggaaggaucuccaggcaaguucuggaauacuacgaucgcggucucaauggccaacauuuuuagagguagcuaccucgcaggcgcugggcuagccuucucccugaugaaaaguuugggaaggggccgccgggggacaggagcacagggcgagacccugggugagaaguggaaaagacagcucaaucagcuuucuaagagcgaguucaacacuuauaagcguucagggaucauggagguugacagguccgaagcuaaagagggacugaagcggggcgaaaccacaaaacacgccgugagucgcgguacugccaaguugcgaugguuugucgagagaaaucuggugaaaccugagggcaagguaauagaucucggguguggaaggggcggguggagcuacuauugcgcgggauuaaagaaagugaccgaaguuaagggcuacacaaaaggugggcccggacacgaggaaccgaucccaauggcuacguacggcuggaaccuggugaaacuucauucuggcaaagacgucuucuuuauuccucccgagaagugugauacccugcuaugcgacaucggggaauccucaccaaaucccacuauugaggagggacggacacuccgcgugcugaaaauggucgaaccuugguugagagguaaccaauucuguaucaagauucugaauccguauaugcccagcgugguugagacccucgaacagaugcagaggaagcacggcgggaugcuuguacgaaacccacugucgagaaauucuacucaugagauguacugggugaguugcggaacaggcaacaucgucuccgcagugaauaugaccagccguauguuacugaacagauuuacgauggcccaccgcaaaccuaccuaugagagggauguugacuugggugcugggacacggcacguggccgucgaacccgagguggcaaaccucgauauaauuggacagagaaucgaaaauaucaagcaugagcacaaaucaacuuggcauuacgacgaagauaacccuuauaagaccugggccuaccacggcuccuaugagguaaaaccaucuggcagcgcuaguuccauggugaaugggguugucaagcugcuaacaaagcccugggacgugauuccuauggugacucaaauagcgaugaccgauacaaccccauucggacagcagcgcgucuuuaaagagaagguugacacuaggacgcccaaagccaagcgagguacagcacaaaucauggaagugaccgcuaaauggcuuuggggcuuccugagccggaacaagaagccgagaauuuguacuagggaggaauuuacccgcaaaguacguucuaaugccgcaaucggggccguguucgucgacgagaaccaguggaacucagcuaaggaagccguggaggaugagcgguuuugggaccucguucauagagaaagggagcugcacaaacagggaaagugcgcgacaugcguguacaacaugaugggcaaacgcgaaaagaaguugggugaguucgggaaagcaaagggaagucgagccauuugguacauguggcugggcgcucgguuucucgaguucgaggcccuuggcuucaugaaugaggaucacugguuuuccagagaaaacagccugucuggggucgagggagaagguuuacauaaacugggcuauaucuugagggacauaucgaagaucccugggggaaauauguacgcagaugacacggcuggcugggauacccgcauuacugaggacgaucuccagaacgaggccagaaucacagacauuauggaaccagagcacgcucugcuagccaaaucaaucuucaaacuuaccuaucaaaauaaagugguacggguucagaggcccgcaaagaacgguacugugauggaugucauaagccgucgagaccagcgcggguccggacaggugggcacauacggccugaauaccuuuacaaacauggaagcgcaacucauuagacagauggagagugaagggaucuucucuccuagcgagcuggagacuccaaacuuggccgaacggguguuagauuggcuggagaaguauggagucgaaaggcucaaacgcauggcuaucuccggugacgacuguguugugaagcccauugaugacagauuugccaccgcacuuacggcucugaaugauaugggcaaaguacggaaggacauaccgcagugggagccuucaaaaggguggaacgauuggcagcaagugcccuucugcagucaucacuuucaccagcuaaucaugaaggacggaagggaaauugucgugccaugucgaaaucaggaugagcugguuggccgugccagagugucucagggugcaggguggagccuccgcgagaccgccugcuugggaaaguccuacgcgcaaauguggcagcugauguauuuccaucggagggaccuuagacuggcugccaacgcaaucuguucagccgucccuguggauuggauucccacaagccgcacuaccuggucuauccacgcucaucaccaguggaugacaacugaagacaugcucuccguauggaaucggguuuggauagaggaaaacccauggauggaggauaaaacccauaucaguagcuggggcgacgugcccuacuuaggcaagagggaagaccaauggugcgggucgcugauuggauugacggcccgagcaacaugggcuaccaauauccaggucgccauuaaccaggugagacggcugaucgguaaugagaacuaccucgauuauaugacuuccaugaaaagguuuaagaaugagucugacccugaaggcgcgcuuugguga

SEQ ID NO: 13315 - RNA, 9879 nt, Artificial Sequence
  derived and/or modified CDS sequence (opt3) from DENV-1__HM181950__SS-prME
uccgugaccaugcugcucaugcuuaugcccacagcacuggcuuuccacuugacuacgagaggaggggaaccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacggaacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggagcggcuuacggcguccuguuuucuggugugagcuggacgaugaagaucgggauuggcguauugcucaccuggcugggauuaaauucacgaaguacuucccugagcaugacauguaucgccgugggccuaguuacccucuaccugggggucauggugcaggcagauucuggaugcgugaucaacuggaaaggccgcgaacuuaagugugguucagggauuuucgucacaaaugagguucacacuuggaccgaacaauauaaguuucaggccgacaguccgaaaagauugagcgcugccauaggaaaggcaugggaggagggcgugugcgguaucagguccgcuacgcggcuggaaaacauuauguggaaacagaucucuaacgagcucaaucauauucuguuagaaaacgacaugaaguucacagugguagucggcgauguggccgggauccuggcgcagggcaagaagaugauacgcccucaacccauggaguacaaauauucguggaaaagcuggggcaaggccaagaucauuggggcugacguucagaauaccacuuuuaucauugauggaccaaacaccccugaaugucccgacgaucagagagcauggaauaucugggagguggaggacuacggcuucgguauauuuacaacuaacauuuggcuuaaguugagggauuccuauacccaggucugcgaccaccgucucaugucagccgcuaucaaagauaguaaggccgugcacgcagacaugggguacuggauugaaucugagaaaaaugaaacauggaagcuggcgcgggccagcuucaucgagguuaagacguguauauggccaaaaucccauacccuauggucaaacggagugcuggaaagcgagaugaucauucccaagaucuauggcgguccuauuucucaacacaauuaccgaccaggcuacuucacucagacagcugggccguggcaucucggaaaacuggagcuugauuuugacuugugcgaaggcaccacuguagucguggaugagcacugcgggaacagaggacccucccugaggacaaccacggugacuggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacagggacccuggcagucuuccuacugcucaucaugggacagcugacuuggaacgaucuuauucguuugugcauaauggugggcgcuaaugccucugacagaauggggaugggaacaaccuaccuggcauuaauggccacauuuaagaugaggccuauguucgcuguuggccuccuguuucgccggcuuacuagcagagaggugcugcuacucaccaucggucugucauuggucgcgaguguggaacugccaaacuccuuagaggaacucggggauggacuggccaugggcauuaugauccuuaaacuguugacggacuuccaaucucaucagcucugggcaacacugcuaagccugaccuuuauuaagacuaccuucucccuucacuaugcuuggaaaacaauggccaugguucucucaaucgugagccuguuucccuugugucugaguacuaccucucagaagacgacaugguuaccgguccuccugggcucccuugggugcaagccucugaccauguucuugauagccgagaauaaaaucuggggaaggcgaagcuggccacucaacgaagguauuauggcuguaggcaucgugucgauucugcuaucaucucugcuuaagaacgauguuccccucgcagggccucugaucgccggaggcauguugauagcguguuacgugauuagugguuccagcgcugacuuaucucuggagaaagccgcagaggucagcugggaagaggaagccgagcauuccggggcuucacacaauauccucguggaaguacaggaugacggaacuaugaagaucaaagaugaggagcgcgacgauacacugaccauucuucugaaggcaacuuugcuagccgugaguggcgucuauccccugagcauaccagcgacacucuuuguuugguacuucuggcagaagaagaagcagcggucuggcgugcugugggacaccccuucacccccagaaguggagagagcuguccuugaugacgggaucuauaggauuaugcagcguggauuacugggucgcagccaggugggcguugggguauuccaagaaaacguguuucauacgauguggcacgucacucggggagccgugcucauguaccagggcaaaagauuggagccgaguugggcaagcguuaagaaagaccugaucuccuacggugggggauggaggcuccagggcucuuggaauaccggcgaggaagugcaggucauugccguggagccugggaagaaccccaaaaauguacaaacagcuccaggaaccuucaagacacccgaaggugaggucggcgccaucgcacuggauuuuaagccugggacuucgggaagcccaauagugaaccgagaaggcaaaaucguuggucuuuaugggaauggaguggucaccacgucaggcacauacguguccgcuauugcccaggcgaaggccagucaggagggcccccugccugagaucgaagacgagguuuuccggaaacgcaacuugacuauuauggaucuacacccggggucuggaaagaccagaagguaucugccagcaaucgugcgggaagcuauaaaacgaaagcucagaacauuaauucuggcccccacccgcgucguggcuagcgagauggcagaagcccuuaaggguaugccuaucagguaccaaacuaccgccguaaaauccgagcauacaggcaaggagaucguggaccugaugugccacgcuacguuuacuaugcgucucuugucaccaguucggguccccaauuauaacaugauuaucauggaugaagcgcauuucaccgacccuucuagcauagcagccagaggguacauuaguacaagggugggaaugggcgaggcugccgcaaucuuuaugaccgccacuccgcccgguuccguggaggcuuucccacagagcaaugcggucauucaggaugaggaacgcgacaucccugagcgaucuuggaacucaggguaugaguggauaacagauuuucccggaaaaaccguaugguucgugccauccauuaagaguggcaaugacaucgccaacugucugaggaaaaauggcaagcggguuauccagcucagcaggaagacguuugauacugaauaccagaaaacaaagaacaacgacugggacuacguggucaccaccgauauuucggagaugggggcaaauuuccgcgcugaccgugugaucgauccuagacggugccugaaacccguuauucuuaaggacggaccagaaagggugauacuagccgguccgaugccugucacuguggcaucugccgcucagcgccgaggcagaaucgggcggaaccacaauaaagagggagaucaguauauuuacaugggccagccccugaacaaugacgaggaucaugcccacuggacagaagcgaagauguuguuagacaacaucaauaccccagaggguaucauucccgcacuguucgaaccugagagggaaaaguccgccgcuauagauggggaguaucgccucagaggcgaggccaggaaaacauuuguagaacugaugcggcguggagaccuuccaguguggcugagcuacaagguugcuucagagggcuuccaauauagugaucgccgauggugcuuugacggggaaagaaacaaucagguccucgaggaaaacauggauguggagaucuggacuaaagagggagaaaggaagaaauugcggccccgcuggcuggacgcaagaacguacucugacccucuagcccugagggaguucaaggaauuugcugccggucggcgauccgugagcggcgaucucauucuugagaucgggaaacugccgcagcacuuaacccagagagcacaaaaugcguuggacaaccuggucaugcuccauaauucagaacagggaggccgcgccuauaggcacgcuauggaggagcugccagauacaauugaaacucuuaugcugcucgccuugaucgcaguucugaccgguggggugacauuauucuuucuaaguggccggggacugggcaagaccagcauagggcuccuuuguguaauggcuuccucugugcuguuguggauggccagcgucgagccccauuggaucgcagccuccauuauccuggaguucuuucucauggugcugcuuauuccugagcccgaccgucagagaacuccacaggauaaccaacucgcuuacguugugaucggacuguuguucaugauacugacggucgcggccaaugagauggguuuacuagaaaccacaaagaaagaccugggcauugggcacguagcagugggaaaccaccaucacgcugccaugcucgauguugaccuucauccugccucagcauggacucuguacgcuguggccaccacaaucauuacccccaugaugaggcacacuaucgagaacacaacggcgaauauaucuuugaccgcuaucgccaaccaggcagccauucugaugggccucgauaaggguuggccaaucaguaaaauggacauuggggucccucugcuugcuuuaggcugcuauucgcaagugaauccgcugacucucacagcagccgucuugaugcugguggcgcauuacgcuaucauaggacccggccuacaagccaaggcaacccgcgaagcccagaaacggaccgcugccgggauuaugaagaacccaacaguugauggaaucguggcaaucgaccuggauccuguaguguaugacgcuaaguuugagaaacagcucggccagauuaugcuucugaucuuguguacuagccaaauacugcucaugcgaacgaccugggcccugugcgaauccauuacauuagcgacugguccccuuaccacacugugggaggggucuccaggaaaguucuggaauaccacuaucgccgucucaauggcaaacauuuuuagaggcagcuaccucgcuggugccggccuagcauucucccugaugaaaagucuagggggaggcaggcgcgggacgggagcucagggcgagacacugggugaaaaguggaaacggcagcucaaucagcuuucuaagagcgaguucaacaccuauaagagaucagggaucauggaaguugaccguuccgaggccaaagaaggacugaagaggggcgagacuaccaaacacgccgugagucgggguacagcgaaguugcgcugguuugucgagcgaaaucuggugaaaccugaaggcaagguaauagaucucggguguggaagaggcggguggagcuacuauugcgcuggauuaaagaaagugacugagguuaagggcuacaccaaaggugggcccggacacgaagaaccgaucccaauggcaacauacggcuggaaccuggugaaacuucauucuggcaaagacgucuucuuuauuccucccgaaaagugugauacgcugcuaugcgacaucggggaguccucaccaaaucccaccauugaggaaggaaggacucuccgggugcugaaaauggucgagccuugguugcgcgguaaccaauucuguaucaagauucugaauccguauaugcccagcgugguugaaacacucgagcagaugcagagaaagcacggcgggaugcuuguaaggaacccacugucgcgaaauucuacccaugagauguacugggugaguugcggaacuggcaacaucgucuccgccgugaauaugacaagccggauguuacugaaccguuuuaccauggcucacagaaaaccuacguaugaacgcgauguugacuugggugccgggaccaggcacguggcagucgagcccgaaguggccaaccucgauauaauuggacagcggaucgagaauaucaagcaugaacacaaaucaacauggcauuacgacgaggauaacccuuauaagacuugggcuuaccacggcuccuaugagguaaaaccaucuggcagcgcgaguuccauggugaaugggguugucaagcugcuaaccaagcccugggacgugauuccuauggugacacaaauagccaugacugauaccacaccauucggacagcagagagucuuuaaagaaaagguugacacccgcacucccaaagcaaagagggguacggcucaaaucauggaggugacagccaaauggcuuuggggcuuccugagccgaaacaagaagccgcggauuuguaccagagaagaguuuacuaggaaaguacgcucuaaugcagccaucggggcuguguucgucgacgaaaaccaguggaacucagccaaggaggcgguggaggaugaacguuuuugggaccucguucaucgggagagagaacugcacaaacagggaaagugcgcaaccugcguguacaacaugaugggcaaaagggagaagaaguugggugaguucgggaaagccaagggaagucgcgcuauuugguacauguggcugggcgcccgauuucucgaguucgaggcacuuggcuucaugaaugaagaucacugguuuucccgggagaacagccugucuggggucgaaggagaggguuuacauaaacugggcuauaucuugagagacauaucgaagaucccugggggaaauauguacgcugaugacacagccggcugggauacgaggauuaccgaggacgaucuccagaacgaagcucgcaucacugacauuauggagccagaacacgcccugcuagcaaaaucaaucuucaaacuuacauaucaaaauaaagugguaagaguucagcggcccgcgaagaacgguaccgugauggaugucauaagcaggcgugaccagcgaggguccggacaggugggcacuuacagucugaauacauuuaccaacauggaggcccaacucauucgccagauggaaucugagggcaucuucagcccuuccgagcuggaaacaccaaacuuggcugagagaguguuagauuggcuggaaaaguauggggucgagcggcucaaaaggauggccaucucaggagacgacuguguugugaagcccauugaugaccgcuuugcaacugcucuuaccgcccugaaugauauggguaaaguaagaaaggacauaccgcagugggaaccuaguaaaggcuggaacgauuggcagcaagugcccuucugcucucaucacuuucaccagcuaaucaugaaggacgggcgggagauugucgugccauguaggaaucaggaugagcugguuggacgagcacgugugagccagggcgccgguuggucccucagagaaacggcgugcuuggggaagucauacgcucaaauguggcagcugauguauuuccaucgccgggaccuuaggcuggccgcaaacgccaucuguagcgcugucccuguggauuggauucccaccucuagaacaacuugguccauccacgcccaucaccaguggaugaccacagaggacaugcucaguguauggaaucgcguuuggauagaagagaacccauggauggaagauaaaacucauaucagcucguggggagacgugcccuacuuaggcaagcgggaggaccaauggugcggcucccugauuggguugaccgcaagggcuacgugggccacaaauauccaggucgcgauuaaccaggugcgaagacugaucggaaaugagaacuaccucgauuauaugaccucuaugaaacgguuuaagaaugaaucagacccugagggugcucuuugguga

SEQ ID NO: 13316 - RNA, 9879 nt, Artificial Sequence
  derived and/or modified CDS sequence (opt3) from DENV-1__HM181952__SS-prME
agcgugacaaugcugcucaugcuuaugcccacagcccuggcuuuccacuugacuacgagaggaggggaaccucauaugaucgucuccaagcaggaaagggggaaaucuuuacuguuuaagaccucagccgguguuaauaugugcacauuaauugccauggaccucggagagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggacuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcugcucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggcagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagugauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguuuuuacauccguggggaaacugguccaucagaucuucggaacggcguacggcguguuguuuucugguguaagcuggaccaugaagauugggauaggcgugcuccugacuugguuaggacuaaauucacgaaguacaucccuaagcaugaccuguaucgcuguuggccucgucacacuguaccuuggggugauggugcaggccgacucuggaugcgucauuaacuggaaaggccgcgaguugaagugugguucagggaucuucguuacuaaugaagugcacaccuggacggagcaauauaaguuucaggcagauaguccgaaaagacugagcgccgcuaucggaaaggccugggaggaaggcgugugcgguauuagguccgcaacacggcucgagaacauaauguggaaacagaucucuaacgaacugaaucauauuuuacuggagaacgacaugaaguucaccguagucgugggcgacguugcugggauccuugugcagggcaagaagaugauucgcccucaacccauggaauacaaauauucguggaaaagcuggggcaaggccaaaaucauaggggcggauguccaaaauuccacuuuuaucauugacggaccaaacaccccugagugucccgaugaccagagagccuggaauaucugggagguggaagauuacggcuucgguauuuuuacaacuaacaucugguugaagcucagggacucauauacccagguuugcgaucaccgucugaugagugcugcaauaaaagacucuaaggccgugcacgcugauaugggguacuggauugagagcgagaagaaugagacauggaagcuagccaaggcauccuucaucgaaguaaaaacguguauuuggccaaagucacauacccuguggagcaacggaguccucgagucugagaugaucauacccaaaauccacggcgguccuauuucccaacauaauuaucggccaggcuacuucacucagacagcggggccguggcaccugggaaaacuugaauuggacuuugaucugugcgagggcaccacugugguggucgacgaacacugcgggaaccgaggacccaguuuaagaacaaccacgguuacuggcaaaaucauucaugagugguguugcaggagcuguacccucccuccacugcgcuuccggggugaggaugggugcugguacggaauggaaaucagacccgugaaggagaaggaagagaaucuuguaaaaucuaugguguccgccggcucaggugaagucgacaguuuuagccugggcuugcucuguauaucgauuaugaucgaggaggugaugaggucccgcuggucucgaaagaugcugaugacagggacccuagcuguuuucuuucugcucaucaugggacagcugacuuggaacgaccuuauucgguugugcaucauggugggcgccaaugcaagcgaucguauggggaugggaacaaccuaucuggcuuuaauggccacauucaaaaugagaccuauguuugcagucggccuccuguucaggcgccuuacuucacgggaagugcugcuacucaccauuggucugaguuugguugccuccguggagcugccaaacucuuuagaggaacucggggacggacuggcuaugggcauaaugauccuuaagcuguugacggauuuucaaagcuaccagcucugggcgacacugcuaucccugaccuucauuaaaacuaccuuuucacuucacuaugccuggaagacaauggcaaugguccucagcaucguaagucuguuccccuugugucugucuacuaccucccagaagacgacaugguuaccggugcuccugggcagccuugggugcaaaccucugaccauguuuuugauugcugaaaauaagaucuggggaagaaaaucguggccacucaacgaggguauaauggccguuggcaucgugucaauucugcuaucuagucugcuuaagaacgacgucccccucgccgggccucugaucgcuggaggcauguugauugcauguuacgugaucuccgguagcucugccgauuuaagccuggagaaagcggcugaaguauccugggaggaagaggccgaacauucaggggcaagucacaauauacucguggagguccaggacgauggaacuaugaagauuaaagacgaggaaagggaugacacacugaccauccuucugaaggccacuuugcuagcuguuagcggcguguauccccugucuaucccagcaacacucuucguguggcauuucuggcaaaagaaaaagcagcgauccggcguccugugggauaccccuucacccccagagguggaacgcgccguucuugacgaugggauuuaccggauaaugcagagaggauuacuggguaggagucagguaggcgugggggucuuucaagagaacguguuccacacgauguggcacguuacucguggagcggugcucauguaucagggcaaacgcuuggagccgagcugggcuuccgucaagaaagaccugaucucuuacggugggggauggcggcuccagggcucguggaauaccggcgaagaggugcagguaauugccgucgaaccugggaagaaccccaagaaugugcaaacagcaccaggaaccuuuaaaacacccgagggugaaguuggcgccaucgcucuggacuucaagccugggacuagcggaucaccaauugugaacagagagggcaaaaucgucggucuuuacgggaauggagugguuaccacguccggcacauaugugagugccauagcacaggcuaaggccucucaggagggcccccugccugaaaucgaggaugaagucuuuaggaaacgaaacuugacuauuauggaccuacauccggggagcggaaagacccggcgcuaccugccagcgaucgugagagaggccauuaagaggaaacuccggacauuaauccuggcacccacccgaguaguggcuuccgaaauggccgaggcucuuaaggguaugccuauaagauaucaaacuaccgcaguuaaaucagagcacacaggcaaggaaauugucgaucugaugugccaugccacguucacuaugcgccucuugucuccagugagggugcccaauuacaacaugaucaucauggacgaggcccacuuuaccgauccuagcaguauugcugcgcguggguauaucuccacacgggucggaaugggcgaagcagccgcuauauucaugaccgccacuccgcccgguagcauggaggcauuuccacagucuaaugccguaauucaggacgaagagagagauaucccugagaggucauggaacuccggguacgaauggauuacagacuuccccggaaaaaccgugugguuuguuccaaguaucaaggcuggcaaugauauagcgaacugucugcgcaagaauggcaaacgagugauucagcucagcagaaagacguucgacacugaguaucagaagacaaagaacaacgauugggacuacgucgugaccaccgacaucucggaaaugggggccaauuuccgggcagauaggguuaucgacccucgccguugccugaaacccgugauucuuaaggauggaccagagagagucauccuagcugguccgaugccugugacuguagccucugcagcccagcggaggggccgcauugggcgaaaccauaauaaggagggagaccaguacauauauaugggccagccccugaacaaugaugaagaccacgcucacuggacagaggccaaaauguuguuagauaacaucaauaccccagaagguauuauccccgcgcuguuugagccugaaagagagaaguccgcagccaucgacggggaguaccggcucaggggcgaagcucgcaaaacauucguggagcugaugagaaggggagaucuuccaguuuggcugagcuauaaggucgccucagaaggcuuucaauacagugaccggcguuggugcuucgauggggagcgcaacaaucaggugcucgaagagaacauggacguggagauuuggacuaaagaaggagagcgaaagaaauugagacccagguggcuggaugcucggacguauucugacccucuagcacugcgcgaauuuaaggaguucgccgcugguagaagguccgucagcggcgaccucauacuugaaaucgggaagcugccgcagcauuuaacccagcgggcccaaaaugcauuggauaaccugguuaugcuccacaauucagagcagggaggccgagcguacagacaugccauggaggaacugccagacacaauugagacucuuaugcugcucgcuuugaucgccgugcugaccggugggguaacauuauuuuuccuaaguggcaaaggacugggcaagaccagcauugggcuccuuugugugauggcauccucuguccuguuguggauggcuagcguggaaccccacuggaucgccgcauccauaauccuggaguuuuuccucaugguucugcuuauuccugagcccgaucgccagaggacuccacaggacaaccaacucgccuauguggucaucggacuguuguuuaugauucugacgguagcugcgaaugaaauggguuuacuagagaccaccaaaaaggaucugggcaucgggcacguggccguugaaaaccaucaccaugcagcuaugcucgacguggaucuucacccugccucagccuggacucuguacgcagucgcuaccacaauaauuacccccaugaugcggcauacuaucgagaacacaacggccaauauuucuuugaccgcgaucgcuaaccaggccgcaauacugaugggacucgacaaaggcuggccaaucaguaagauggauauuggugugccucugcuugccuuagggugcuacucgcaggucaauccgcugacucucacagcugcaguguugaugcugguugcccacuaugcgaucgugggccccggacuacaagcuaaggccacccgugaagcacagaaaagaaccgccgcuggcauuaugaagaacccaacaaucgacgggauaguagccauugaucuggacccuguggucuacgaugcaaaauucgagaagcagcucggacagaucaugcuucugaucuuguguacuagccaaauucugcucaugaggacgaccugggcucugugcgaguccaucacauuagccacuggcccccuuaccacacugugggaagguucuccagggaaauuuuggaauaccacuauagcgguuucaauggccaacauuuuccgcggaagcuaucucgcaggcgcuggucuagccuucucccugaugaagaguuugggcgggggacggcgaggcacgggggcacagggagagacacugggcgaaaaguggaaaagacagcucaaucagcuuucuaagagcgaguuuaacaccuacaaaaggucagguaucauggaaguggaccgcuccgaggcuaaggaggggcugaaacggggagaaacuaccaagcacgccgucaguagaggcacagccaaguugcguugguucguggagaggaaucugguaaaaccugaagguaaggugauugaccucggcugugggcggggaggcuggagcuauuacugcgcggggcugaaaaagguuacugaggugaaaggauauaccaagggcggucccgggcaugaagaaccgaucccaauggcuacauacggauggaaccuagucaaacuucacucuggcaaggauguguuuuucauaccucccgagaagugugacacgcugcuaugcgauaucggcgaauccucaccaaaucccaccauugaggaagggcgcacucuccgaguccugaaaaugguggagccuugguugagaggaaaccaauuuuguaucaagauucugaauccguacaugcccagcguuguagagacacucgaacagaugcagaggaaacaugguggcaugcuugugcggaacccacugucgcgcaauucuacccacgagauguauugggucaguugcgggacuggaaacaucguguccgcaguuaauaugacaagcagaauguuacugaacagguucaccauggcccaccgaaagccuacguacgaacgggacguggauuugggcgcugguacccgucaugucgccguggagcccgaaguagcaaaccucgacauuaucgggcagagaauagagaauauuaaacacgagcauaagucaacauggcacuaugaugaagacaacccuuacaagacuugggccuaucauggauccuacgaggugaaaccaucuggcagcgcuaguuccaugguuaauggcgucgugaagcugcuaaccaaacccugggaugugaucccuauggucacacaaaucgcgaugacugacaccacaccauuugggcagcagcgcguuuucaaggaaaaaguggauaccaggacucccaaggccaagcggggaacggcacaaauuauggagguaacagcuagauggcuuugggguuuucugagccgcaacaaaaagccgaggauauguacccgagaagaguucacucggaaagugagaucuaaugccgcaaucggcgccgucuuuguggacgagaaccaguggaacucagcuaaggaagccguugaggacgauagguucugggaccucgugcaccgcgaacgugagcugcacaaacaggggaagugcgcgaccugcgucuauaacaugaugggaaagcgggagaaaaaguugggcgaguuugguaaagcaaaggggaguagagccauuugguacauguggcugggagcuagguuccucgaguucgaagcccuuggcuuuaugaaugaggaucauugguucucccgcgaaaacagccugucuggcguggagggggagggauuacacaaacuggguuacaucuugcgagacauuucgaagaucccuggcgggaauauguaugcagaugacacagcuggaugggauacgcggauaaccgaagacgaucuccagaacgaggccaaaaucacugacauuauggaaccagagcaugcucugcuagccaagucaaucuuuaaacuuacauaccaaaauaaaguaguuagagugcagaggcccgcaaagaacggcaccgucauggaugugauuagccgcagagaccagcgggguuccggacaggugggaacuuauggccugaauacauucaccaacauggaagcgcaacucaucaggcagauggagagugagggcauauuucugccuaacgaauuggagacaccaaauuuagccgaacguguccuggauuggcucgagaaauacgggguugaacgacuuaagcgcauggcuauuucuggagacgacugugugguaaaacccaucgaugacagauucgccacugcacugaccgcucuaaacgauauggguaaggugcggaaggacaucccgcagugggagccuagcaaaggcuggaaugauuggcagcaaguccccuuuugcucccaccacuuccaucagcugauuaugaaggacgggagggagauagugguuccaugucgcaaccaggaugaacucgugggcagagcacgggucucacagggcgcagguuggaguuugagggagacggccugccuggggaaaucuuaugcgcaaauguggcagcuuauguacuuucaccgacgugaccugagacucgcugccaaugcaaucuguagcgccgugccuguagauuggguucccaccucccgcacaacuuggucaauucaugcucaccaucaguggaugaccacagaagacauguuaagcguguggaaccgggucuggaucgaggaaaauccauggauggaggauaagacuaggauuucuuccugggaggacgugcccuaucugggaaaaagagaagaccaauggugcggcaguuugaucggccugaccgcccgcgcaacgugggcuacaaacauacagguugccaucaaucaggugcggaggcucauugggaacgagaauuacagcgauuacaugaccucgaugaagcgauucaagaacgaauccgagccugagggagcgcuuugguga

SEQ ID NO: 13317 - RNA, 9879 nt, Artificial Sequence
  derived and/or modified CDS sequence (opt3) from DENV-1__HM181953__SS-prME
agcgugaccaugcugcucaugcuuaugcccacagcacuggcuuuccacuugacuacgagaggaggggagccucauaugaucgucuccaagcaagaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaagacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacggaacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccugguucagggcaaaaagaugauacgcccucaacccauggaguacaaauauucguggaaaagcuggggcaaggccaagaucauuggggcggacgugcagaauacuaccuuuaucauugauggaccaaacacaccugaaugucccgacgaucagagagccuggaauaucugggaggucgaggacuacggcuucgguauauuuacuaccaacauuuggcuuaaguugagggauuccuauacacaggugugcgaccaccgucucaugucagcugcaaucaaagauaguaaggccguucacgcugacaugggguacuggauugaaucugagaaaaaugaaacguggaagcuggcccgggcauccuucaucgaggugaagaccuguauauggccaaaaucccauacucuauggucaaacggaguacuggaaagcgagaugaucauucccaagaucuauggcgguccuauuucucaacacaauuaccgaccaggcuacuucacacagaccgcggggccguggcaucucggaaaacuggagcuugauuuugacuugugcgaaggcacuacagucgugguggaugagcacugcgggaacagaggacccucccugaggaccacgacugucaccggcaagaucauacacgaaugguguugccgcaguuguacauuaccuccacuccgguucagaggugaggacgggugcugguauggaauggagauuaggcccguuaaagaaaaggaggaaaaucugguaaagagcaugguaucugccggcuccggugagguggacucauuuagucuuggccuguuguguaucagcaucaugauugaagaggucaugcgcucgcgauggucccggaaaaugcucaugaccgggacucuggcuguguuccuacugcucaucaugggacagcugacauggaacgaucuuauucguuugugcauaaugguuggcgccaaugcaucugacagaauggggaugggaaccacauaccuggcuuuaauggccacuuuuaagaugaggccuauguucgcagugggccuccuguuucgccggcuuaccagcagagagguccugcuacucacgaucggucugucauugguggccaguguugaacugccaaacuccuuagaggaacucggggauggacuggcuaugggcauuaugauccuuaaacuguugacagacuuccaaucucaucagcucugggcgacccugcuaagccugacuuuuauuaagaccacauucucccuucacuaugccuggaaaacuauggcaauggugcucucaaucgucagccuguuucccuugugucugaguaccacgucucagaagacaaccugguuaccgguacuccugggcucccuugggugcaagccucugacuauguucuugauagcugagaauaaaaucuggggaaggcgaagcuggccacucaacgaagguauuauggccgugggcaucguuucgauucugcuaucaucucugcuuaagaacgaugugccccucgccgggccucugaucgcuggaggcauguugauagcauguuacgucauuagugguuccagcgccgacuuaucucuggagaaagcggcugaggugagcugggaagaggaagccgagcauuccggggcaucacacaauauccucguagaagugcaggaugacggaacaaugaagaucaaagaugaggagcgcgacgauacccugacuauucuucugaaggccacauugcuagcugucaguggcguuuauccccugagcauaccagcaacccucuuugugugguacuucuggcagaaaaagaagcagcggucuggcgugcugugggacacgccuucacccccagaagucgagagagccgugcuugaugacgggaucuauaggauuaugcagcguggauuacugggucgcagccagguuggcguagggguguuccaagaaaacgucuuucauacuauguggcacgugacccggggagcgguucucauguaccagggcaaaagauuggagccgaguugggcuagcgugaagaaagaccugaucuccuacggugggggauggaggcuccagggcucuuggaauacaggcgaggaaguccaggugauugccguagagccugggaagaaccccaaaaauguccaaaccgcaccaggaacauucaagacucccgaaggugaggugggcgccaucgcucuggauuuuaagccugggaccucgggaagcccaauaguuaaccgagaaggcaaaaucgugggucuuuaugggaauggagucgugacgacaucaggcacuuacguuuccgccauugcacaggcuaaggccagucaggagggcccccugccugagaucgaagacgagguguuccggaaacgcaacuugaccauuauggaucuacacccggggucuggaaagacaagaagguaucugccagcgaucguccgggaagccauaaaacgaaagcucagaaccuuaauucuggcacccacucgcgugguagcuagcgagauggccgaagcucuuaaggguaugccuaucagguaccaaaccacagcagugaaauccgagcauacgggcaaggagaucguugaccugaugugccacgccacuuuuaccaugcgucucuugucaccaguccgggugcccaauuauaacaugauuaucauggaugaagcccauuucacagacccuucuagcauagcugcgagaggguacauuaguaccagggugggaaugggcgaggcagccgcuaucuuuaugacugccacaccgcccgguuccgucgaagcauucccacagagcaaugccguaauucaggaugaggaacgcgacaucccugagcgaucuuggaacucaggguaugaguggauaaccgauuuucccggaaaaacggugugguucguuccauccauuaagaguggcaaugacaucgcuaacugucugaggaaaaauggcaagcgggugauccagcucagcaggaagacuuuugauacagaauaccagaaaaccaagaacaacgacugggacuacgucgugaccacugauauuucggagaugggggcgaauuuccgcgccgaccguguuaucgauccuagacggugccugaaacccgugauucuuaaggacggaccagaaagggucauacuagcagguccgaugccugugacaguagcuucugccgcacagcgccgaggcagaaucgggcggaaccacaauaaagagggagaucaguauauuuacaugggccagccccugaacaaugacgaggaucaugcccacuggaccgaagcuaagauguuguuagacaacaucaauacaccagaggguaucauucccgcccuguucgaaccugagagggaaaaguccgcggcaauagauggggaguaucgccucagaggcgaggccaggaaaacuuuuguggaacugaugcggcguggagaccuuccaguuuggcugagcuacaaggucgcuucagagggcuuccaauauagugaucgccgauggugcuuugacggggaaagaaacaaucaggugcucgaggaaaacauggauguggagaucuggacgaaagagggagaaaggaagaaauugcggccccgcuggcuggacgccagaaccuacucugacccucuagcucugagggaguucaaggaauuugcagccggucggcgauccgucagcggcgaucucauucuugagaucgggaaacugccgcagcacuuaacacagagagcucaaaaugccuuggacaaccugguuaugcuccauaauucagaacagggaggccgcgcauauaggcacgcgauggaggagcugccagauacuauugaaacccuuaugcugcucgccuugaucgcugugcugacaggugggguaaccuuauucuuucuaaguggccggggacugggcaagacuagcauagggcuccuuugugugauggccuccucuguccuguuguggauggcaagcguggagccccauuggaucgcugccuccauuauccuggaguucuuucucaugguucugcuuauuccugagcccgaccgucagagaacgccacaggauaaccaacucgcauacguggucaucggacuguuguucaugauacugaccguagccgcuaaugagauggguuuacuagaaacaacuaagaaagaccugggcauugggcacguggcgguuggaaaccaccaucacgccgcaaugcucgauguggaccuucauccugcuucagccuggacccuguacgccgucgcaacaaccaucauuacucccaugaugaggcacacaaucgagaacacgaccgcuaauauaucuuugacugccaucgcgaaccaggcugccauucugaugggccucgauaaggguuggccaaucaguaaaauggacauuggggugccucugcuugcauuaggcugcuauucgcaggucaauccgcugacacucaccgccgcuguguugaugcugguugcacauuacgccaucauaggacccggccuacaagcgaaggcuacccgcgaagcccagaaacggacagcagccgggauuaugaagaacccaacuguggauggaaucguagcuaucgaccuggauccuguggucuaugacgccaaguuugagaaacagcucggccagauuaugcuucugaucuuguguacgagccaaauacugcucaugcgaaccacaugggcacugugcgaauccauuacuuuagcuaccgguccccuuacaacccugugggaggggucuccaggaaaguucuggaauacuacgaucgccguuucaauggcgaacauuuuuagaggcagcuaccucgccggugcaggccuagcuuucucccugaugaaaagucuagggggaggcaggcgcgggacaggagcccagggcgagacccugggugaaaaguggaaacggcagcucaaucagcuuucuaagcuggaguucaacacuuauaagagaagcgggaucauggaaguggaccguucagaggcaaaagaaggauugaagaggggcgagaccacaaaacacgcugucucccgggguacugccaagcugcgcugguuuguggagcgaaaucucguaaaaccugaaggcaaggugauagauuuaggguguggaagaggcggguggaguuacuauugcgccggacugaagaaaguuaccgaggugaagggcuacacaaaaggugggcccggacacgaagaaccgaucccaauggcgacguacggcuggaaccuugucaagcugcauagcggcaaagacguguucuuuauuccucccgaaaagugugauacccuacucugcgacaucggggagucuuccccaaaucccacuauugaggaaggaaggacacugcgggucuugaaaaugguggagccuuggcugcgcgguaaccaauucuguaucaagauucucaauccguauaugcccucaguuguagaaacccuugagcagaugcagagaaagcacggcgggaugcuggugaggaacccauuaagccgaaauucgacucaugagauguacugggucucuugcggaacaggcaacaucgugagugcuguuaauaugaccucccggaugcuguugaaccguuuuacgauggcacacagaaaaccuaccuaugaacgcgauguggaccucggugccgggacaaggcacgucgcuguggagcccgaaguagccaaccuggauauaauuggacagcggaucgagaauaucaagcaugaacacaaaagcacuuggcauuacgacgaggauaacccuuauaagaccugggcauaccacggcucauaugaggugaaaccauccggcucugccagcaguaugguuaauggggucgugaagcuacuuacaaagcccugggacgugauuccuauggucacucaaauagcuaugaccgauacaaccccauucggacagcagagaguuuuuaaagaaaagguggacacucgcacgcccaaagcgaagagggguacagcccaaaucauggagguaaccgcaaaauggcuguggggcuuccucucccgaaacaagaagccgcggauuuguacuagagaagaguuuaccaggaaagugcgcagcaaugcugccaucggggcagucuucguggacgaaaaccaguggaacucugccaaggaggcuguugaggaugaacguuuuugggaccuggugcaucgggagagagaauugcacaaacagggaaagugcgccacaugcgucuacaacaugaugggcaaaagggagaagaagcugggugaguucgggaaagcgaagggaucacgcgcaauuugguacauguggcucggcgcccgauuucuugaguucgaggcucugggcuucaugaaugaagaucacugguuuagucgggagaacuccuuaagcgggguggaaggagagggucugcauaaauugggcuauauccucagagacauaucuaagaucccugggggaaauauguacgccgaugacacggcaggcugggauaccaggauuacugaggacgaucugcagaacgaagcucgcaucacagacauuauggagccagaacacgcccuacuugcuaaaucgaucuucaagcugaccuaucaaaauaaaguaguuagagugcagcggcccgccaagaacgguacugucauggaugugauaucaaggcgugaccagcgagggagcggacaggugggcacauacggccucaauaccuuuacaaacauggaggcacaacugauucgccagauggaauccgaggggaucuucaguccuucugaguuggaaacuccaaacuuagcggagagaguccuggauuggcucgaaaaguauggaguugagcggcuuaaaaggauggccaucagcggugacgacugugugguaaagcccauugaugaccgcuuugcuaccgcccugacggcacuaaaugauaugggcaaagugagaaaggacauaccgcagugggaaccuuccaaaggguggaacgauuggcagcaaguccccuucugcucacaucacuuucaccagcugaucaugaaggacggacgggagauugugguuccauguaggaaucaggaugagcucgugggccgagcucgugucagucagggugccggguggucuuugagagaaaccgcaugccugggaaagagcuacgcccaaauguggcagcuuauguauuuccaucgccgggaccugaggcucgcggcuaacgccaucuguuccgcagugccuguagauuggauucccacaucaagaacuaccuggagcauccacgcccaucaccaguggaugacaacugaggacauguuaucuguuuggaaucgcguguggauagaagagaacccauggauggaagauaaaacccauaucuccaguuggggcgacguccccuaccugggcaagcgggaggaccaauggugcgggagcuugauuggacugacggcuagggccacaugggcaaccaauauccagguggcuauuaaccagguucgaagacucaucgguaaugagaacuaccuugauuauaugacuucgaugaaacgguuuaagaaugaauccgacccugagggcgcccugugguga

SEQ ID NO: 13318 - RNA, 9879 nt, Artificial Sequence
  derived and/or modified CDS sequence (opt3) from DENV-1__KF921933__SS-prME
agcgugaccaugcugcucaugcuuaugcccacagcccuggcuuuccacuugacuacgagaggaggggagccucauaugaucgucuccaagcaggaaaggggaaagucuuuacuguuuaagaccucagcggguguuaauaugugcacacucauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacugcucaagacagaggugaccaacccugccauucugaggaaacuuugcaucgaagcuaagauaucuaauacgaccacagauagcaaauguccaacucaaggagaggccacccugguggaagaacaggacgcaaacuucgucugccggcgcacauuuguugaucgaggcugggguaauggguguggauuguucggcaagggcucccucauuacuugcgcuaaguuuaaaugcgugaccaagcuggaggggaaaaucguacaguacgaaaacuuaaaguauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaagaacaggacuggacuucaacgaaaugguguugcuaacgaugaaagagaagucuuggcugguccauaaacagugguuucucgaucugccgcuucccuggaccuccggcgcaucaacuagccaagagacauggaauaggcaggaccuguuggugaccuucaagacagcucacgccaagaaacaggaaguaguugugcucgguagucaagagggggcuaugcacacugcccugaccggcgcaacggaaauucagaccucuggaacaacuaccauauuugccggccauuuaaagugccggcugaaaauggauaagcuaacacucaaagggauguccuaugucauguguacuggcucguucaagcuggagaaggaaguggcugagacccagcacgguacgguccuugugcagaucaaauacgagggcacagacgcgccuugcaagauuccauucucgacccaagaugaaaaagggguuacucagaacggacguuugaucacagcaaaucccauagugaccgacaaggagaaaccuguaaacauugaagccgagccacccuuuggcgagucuuauaucgucaucggugcuggggaaaaggcccugaagcucuccugguucaaaaagggcucaaguauuggaaaaauguuugaggcaacugcccgcggcgcuagaaggauggccauccugggggauaccgcaugggacuucggaagcauugguggcguguuuacauccguugggaaacuugugcaucagauauucggaacggcguacggcguccuguuuucuggugugagcuggaccaugaaaaucgggauuggcguauugcucacuuggcugggauuaaauucacggaguacaucccugagcaugaccuguaucgcugugggccuaguuacacucuaccugggggucauggugcaggccgauucuggaugcgugaucaacuggaagggccgagaacuuaagugugguucagggauuuucgucacuaaugagguucacaccuggacggaacaauauaaauuucaggcagacaguccgaagcgcuugagcgccgcuauaggaaaagccugggaggagggcgugugcgguaucagauccgcaacaaggcuggaaaacauuauguggaagcagaucucuaacgagcucaaucauauucuguuagaaaacgacaugaaauucaccgugguagucggcgauguggcugggauccuggcccagggaaagaaaaugauacggccucaacccauggaguacaaguauucguggaaaagcuggggcaaggcgaagaucauuggggccgacguucagaauacuaccuuuaucauugauggaccaaacacaccugaaugucccgacgaucagcgcgcuuggaauaucugggagguggaggacuacggcuucgguauauuuacuaccaacauuuggcuuaaauugagagauuccuauacacaggucugcgaccacaggcucaugucagcagccaucaaggauaguaaagcugugcacgccgacaugggguacuggauugaaucugagaagaaugaaacguggaagcuggcacgugcgagcuucaucgagguuaaaaccuguauauggccaaagucccauacucuauggucaaacggagugcuggaaagcgagaugaucauucccaaaaucuauggcgguccuauuucucaacacaauuaccggcucggcuacuucacacagaccgccgggccauggcaucugggaaaacuugaguuggauuuugaccugugcgaaggcacuacaguagucguggaugagcacugcgggaaccgaggaccguccuuaagaaccacgacugugaccggcaaaaucauacacgaaugguguugcaggaguuguacacuacccccucugcgcuuccggggugaggacgggugcugguauggaauggagauuagaccagucaaggaaaaggaggaaaaucuuguuaaaagcauggugucugcuggcuccggugagguagacucauuuagucugggcuugcucuguaucagcaucaugauugaagaggugaugaggucgcgcuggucccgaaagaugcugaugaccgggacucuagccgucuuccugcuccugaucaugggacagcuuacauggaacgauuugauucggcugugcauaauggugggcgcaaaugcuucugaccguauggggaugggaaccacauacuuagcccucauggcaacuuuuaaaaugagacccauguucgccguuggccugcuuuuuaggcgccugaccagccgggaggugcuacuccugacgaucgguuugucacuggucgcuaguguggaauuaccuaacucccucgaggaacugggggauggacuugcgaugggcauuaugauccugaaguugcucacagacuuccaaucucaucagcugugggccacccuacugagccuuacuuuuauuaaaaccacauucucccuccacuaugcauggaagacuauggcuaugguucugucaaucgugagcuuguuuccacuguguuuaaguaccacgucucagaagacaaccuggcuccccguccugcuuggcucccuggggugcaaaccguugacuauguuccucauagccgagaauaagaucuggggaagaaggagcuggccucugaacgaagguauuauggccguaggcaucgugucgauucuacugucaucucuucucaaaaacgauguuccacuggcugggcccuugaucgcaggaggcauguuaauagccuguuacgugauuagugguuccagcgcggaccugucucucgagaaggcugccgaggucagcugggaagaggaagcagagcauuccggggccucacacaauauccugguggaaguacaggaugacggaacaaugaaaaucaaggaugaggagcgagacgauacccuuacuauucuguugaaagcuacacuacuggcagugaguggcgucuauccucucagcauacccgccacccuguuuguuugguacuucuggcaaaagaagaaacagcgcucuggcgugcuuugggacacgccauccccucccgaaguggagcgggcggucuuagaugacgggaucuauagaauuaugcagaggggacugcucggucguucacaggugggcguugggguauuccaagaaaacguguuucauacuauguggcacgucacccgcggagcuguguugauguaccagggcaagcggcuggagccaaguugggccagcguuaaaaaggaccucaucuccuacggugggggauggagacugcagggcucuuggaauacaggcgaggaagugcaggucauugcaguggagccggggaaaaacccuaagaauguacaaaccgcccccggaacauucaagacuccagaaggugaggucggcgcuaucgcccuugauuuuaaacccgggaccucgggaagcccuauagugaacagggaaggcaagaucguuggucuguaugggaauggaguggucacgacaucaggcacuuacguguccgcaauugcucaggccaaagcgagucaggagggcccauugcccgagaucgaagacgagguuuuccgaaagcggaaccuaaccauuauggaucugcacccugggucuggaaaaacacgcagauaucucccggccaucgugagggaagcaauaaagcggaaguuacgaacccugauucuugcuccaacuagagucguggccagcgagauggcugaagcacugaaagguaugcccauccgcuaccaaaccacagccguaaaguccgagcauacgggcaaagagaucguggaccucaugugccacgccacuuuuaccaugagguugcugucaccuguucgugucccaaauuauaacaugauuaucauggaugaagcucauuucacagaccccucuagcauagcggcacggggguacauuaguaccagagugggaaugggcgaggccgcugccaucuuuaugacugcaacaccuccggguuccguggaagccuucccccagagcaaugcugucauucaggaugaggaaagggacaucccagagcgcucuuggaacucaggguaugaguggauaaccgauuuuccuggaaagacgguaugguucgugcccuccauuaaaaguggcaaugacaucgcgaacugucuccgaaagaauggcaagagaguuauccagcugagccggaaaacuuuugauacagaauaccaaaagaccaaaaacaacgacugggacuacguggucaccacugauauuucggagaugggggccaauuucagggcagaccgcgugaucgauccacguagaugccuuaagccuguuauucuaaaagacggacccgaacgggugauacuggcugguccaaugccggucacaguggccucugcagcccagaggcgcggccgaaucgggagaaaccacaauaaggagggagaucaguauauuuacaugggccagccuuugaacaaugacgaggaucaugcucacuggaccgaagccaagauguuacuggacaacaucaauacacccgaggguaucauuccagcacucuucgaacccgagcgggaaaaauccgcagccauagauggggaguauaggcugcgcggcgaggcuagaaagacuuuuguagaacuuaugaggcggggagaccugccuguguggcucagcuacaaaguugccucagagggcuuccaauauagugaucgucgcuggugcuuugacggggaacgaaacaaucaggucuuggaggaaaacauggauguggagaucuggacgaaggagggagaaaggaagaagcugaggccacgguggcuagacgcucgcaccuacucugacccccuggcacucagagaguucaaagaauuugccgcugguaggcgguccgugagcggcgaucuuauucuggagaucgggaaguuaccucagcacuugacacagcgagcccaaaaugcacuggacaaccucgucaugcugcauaauucagaacagggaggcagagcguaucgccacgccauggaggagcuuccggauacuauugaaacccugaugcucuuggcucugaucgccguuuuaacagguggggugacccuauucuuucugaguggcaggggacucggcaagacuagcauagggcuucuguguguaauggcauccucuguguugcuguggauggcuagcgucgagccacauuggaucgccgcauccauuauccucgaguucuuucugauggugcuucucauucccgagccugaccggcagcguacgccccaggauaaccaacuggccuacguugugaucggauugcuguucaugauauuaaccgucgcugcgaaugagaugggucuacuggaaacaacuaaaaaggaccucggcauugggcacguagccgugggaaaccaccaucacgcagcuaugcuugauguugaccugcauccagccucagccuggaccuuguacgcaguggcuacaaccaucauuacuccuaugaugagacacacaaucgagaacacgaccgccaauauaucucugacugcgaucgcuaaccaggccgcaauucucaugggccuggauaaagguuggcccaucaguaagauggacauuggggucccacuuuuagcccugggcugcuauagccaggugaauccucucacauugaccgcugcaguccugaugcuaguggcccauuacgcgaucauaggaccgggccugcaagcuaaagccaccagggaagcacagaagcgcacagccgcugggauuaugaagaaccccacuguugauggaaucguggccaucgaccucgauccaguaguguaugacgcaaaauuugagaagcagcuuggccagauuaugcuguugauccuguguacgagccaaauacuccugaugcggaccacaugggcuuuaugcgaauccauuacucuugccaccgguccucugacaacccucugggaggggucucccggaaaauucuggaauacuacgaucgcggucucaauggccaacauuuuucgaggcagcuaccuagcaggagcuggccuggccuucuccuugaugaagagucuaggggguggcagaagggggacaggagcacagggcgagacccucggugaaaaauggaagcgccagcuuaaucagcugucuaagagcgaguucaacacuuauaaacggucagggaucauggaaguugacagauccgaggcuaaggaaggauugaaacguggcgagaccacaaagcacgccgugaguagggguacugccaaacugcggugguuugucgagcgcaaucucgugaagccagaaggcaagguaauagauuuaggguguggacgaggcggguggagcuacuauugcgcgggacugaaaaaggugaccgagguuaaaggcuacacaaagggugggccuggacacgaagaacccaucccgauggcuacguacggcuggaaccuugugaaacugcauucuggcaaggacgucuucuuuauuccaccugaaaaaugugauacccuacucugcgacaucggggaguccucacccaauccaacuauugaggaaggaagaacacugaggguguugaagauggucgagcccuggcugcgggguaaccaauucuguaucaagauucucaauccuuauaugccgagcgugguugaaacccuugagcagaugcagcgcaaacacggcgggaugcugguaagaaaccccuuaucgagaaauucuacucaugagauguacugggugaguugcggaacaggcaacaucgucuccgcagugaauaugaccagccgaaugcuguugaaccgguuuacgauggcccaccguaagccaaccuaugaaagagauguugaccucggugcugggacacgccacguggccgucgagccugaaguggcaaaccuggauauaauuggacagaggaucgagaauaucaaacaugaacacaagucaacuuggcauuacgacgaggauaaccccuauaaaaccugggccuaccacggcuccuaugagguaaagccuucuggcagcgcuaguuccauggugaaugggguugucaagcuacuuacaaaaccaugggacgugauucccauggugacucaaauagcgaugaccgauacaaccccuuucggacagcagcgggucuuuaaggaaaaaguugacacuagaacgccaaaggccaaacgcgguacagcacaaaucauggaggugaccgcuaaguggcuguggggcuuccucagcaggaacaagaaaccccgaauuuguacucgggaagaguuuaccagaaagguaaggucuaaugccgcaaucggggccguguucgucgacgaaaaccaguggaacucagcuaaagaggccguggaggauggacgcuuuugggaccugguucaucgugaacgggaguugcacaagcagggcaaaugcgcgacaugcguguacaacaugauggguaagagagaaaagaaacugggggaguucggaaaggcaaaaggcaguagggccauuugguacauguggcucggcgcucgcuuucuugaguucgaggcccugggguucaugaaugaggaucacugguuuucccgagaaaacagcuuaucuggagucgagggugaaggccugcauaaguugggguauauccuccgggacauaucgaaaaucccgggaggcaauauguacgcagaugacacggcugguugggauaccagaauuacugaggacgaucugcagaacgaggccaggaucacagacauuauggaaccugagcacgcucuacuugccaagucaaucuucaaacugaccuaucaaaauaaggugguacgcguucagagaccagcaaagaacgggacugugauggaugucauaagccggagggaccagcguggauccggccaggugggcacauacgggcucaauaccuuuacaaacauggaagcgcaacugauucgacagauggagagugaaggaaucuucucucccagcgaguuggagacuccuaacuuagccgaacgcgugcuggauuggcucgagaaauauggugucgaaagacuuaagcggauggcuaucuccggcgacgacuguguugugaaaccaauugaugacagguuugccaccgcacugacggcucuaaaugauauggggaagguacgcaaagacauaccccagugggagccgucaaagggauggaacgauuggcagcaagugccuuucugcagucaucacuuucaccagcugaucaugaaggacggcagagaaauugucgugcccugucggaaucaggaugagcucguugguagggcccgagugucucagggggcaggauggagcuugcgugagaccgccugccugggcaaauccuacgcgcaaauguggcagcuuauguauuuccauagacgcgaccugcggcucgcugccaacgcaaucuguucagccgucccaguggauuggauuccuacaagcaggacuaccuggucuauccacgcucaucaccaguggaugacaacugaagacauguuauccguauggaauagaguuuggauagaggaaaaccccuggauggaggauaagacccauaucaguagcuggggcgacgugccauaccuggggaaacgcgaagaccaauggugcggaucguugauuggucugacggcccgggcaacaugggcuaccaauauccaggucgccauuaaccaggugaggcgacucaucggcaaugagaacuaccuugauuauaugacuuccaugaagagauuuaaaaaugagucugaccccgaaggggcgcugugguga

SEQ ID NO: 13319 - RNA, 9879 nt, Artificial Sequence
  derived and/or modified CDS sequence (opt3) from DENV-1__HM181954__SS-prME
agcgugaccaugcugcucaugcuuaugccaacagcccuggcuuuccacuugacuacgagaggaggggagccucauaugaucgucuccaagcaagaaagaggaaaaucuuuacuguuuaagaccucagccgguguuaauaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccccuggcgcauccacuucacaagagacauggaaucggcaggaccuguuggugaccuucaaaacagcucacgccaagaagcaggaaguaguugugcucgguagccaagagggggcuaugcacacugcccugaccggcgcaacggaaauucagaccaguggaacaacuaccauauuugccggccauuuaaaaugccgucugaagauggauaaacuaacacucaaggggaugucuuaugucauguguacuggauccuucaaacuggagaaggaaguggcugagacccagcacgguacgguccuugugcagaucaaguacgagggcacagacgcgccaugcaaaauucccuucagcacccaagaugaaaaggggguuacucagaacggacgcuugaucacagcaaauccuauagugaccgacaaagagaagccaguaaacauugaagccgagcccccguuuggcgagucguauaucgucaucggugcuggggaaaaagcccugaagcucucuugguucaagaaaggcuccucaauuggaaagauguuugaggcaacugccagaggcgcuaggcggauggccauccugggggauaccgcaugggacuucggaaguauugguggcguguuuacaagcguugggaaacuugugcaucagauauucggagcggcuuacggcguccuguuuuccggugugucuuggacgaugaagaucgggauuggcguauugcucaccuggcugggauuaaauagccgaucaacaagucuguccaugacauguaucgccgugggccuaguuacccucuaccugggggucauggugcaggcagauagcggaugcgugaucaacuggaaaggccgcgaacuuaagugugguucugggauuuucgucacaaaugagguucacacuuggaccgaacaauauaaguuucaggccgacucaccuaaaagauugagugcugccauaggaaaggcaugggaggagggcgugugcgguaucaggagcgcuacgcggcuggaaaacauuauguggaaacagaucuccaacgagcucaaucauauucuguuagaaaacgacaugaaguucacagugguagucggcgauguggccgggauccuggcgcagggcaagaagaugauacgcccccaaccaauggaguacaaauauucuuggaagucguggggcaaggccaaaaucauuggggcugacguucagaauaccacuuuuaucauugauggaccuaacacccccgaauguccagacgaucagagagcauggaauaucugggagguggaggacuacggcuucgguauauuuacaacuaacauuuggcuuaaguugagggauagcuauacccaggccugcgaccaccgucucauguccgcugccaucaaagauucaaaggcaguccacgcggacaugggguacuggauugaaagugagaaaaaugaaacauggaagcuggcccgggcuucuuucaucgaggugaagacguguauauggcccaaaagccauacccuaugguccaacggaguucuggaaucagagaugaucauuccuaagaucuauggcgguccaauuagccaacacaauuaccgaccgggcuacuucacucagacagccgggcccuggcaucucggaaaacuggagcuugauuuugacuugugcgaaggcaccacugugguagucgaugagcacugcgggaacagaggaccuucucugaggacaaccacggugacuggcaagaucauacacgaaugguguugccgcuccuguaccuuaccaccccuccgguucagaggugaggacgggugcugguauggaauggagauuaggccugugaaagaaaaggaggaaaaucuggucaagaguaugguuagcgcaggcucuggugagguggacuccuuuucacuuggccuguuguguaucaguaucaugauugaagagguaaugcgcagccgauggucgcggaaaaugcucaugacagggacccuggcuguguuccuacugcucaucaugggacagcugacuuggaacgaucuuauucguuugugcauaauggucggcgccaaugcauccgacagaauggggaugggaacaaccuaccuggccuuaauggcuacauuuaagaugaggccaauguucgcggugggccuccuguuucgccggcuuacuucuagagagguucugcuacucaccaucggucugagcuugguggccucagucgaacugcccaacaguuuagaggaacucggggauggacuggcaaugggcauuaugauccuuaaacuguugacggacuuccaaucccaucagcucugggcuacacugcuaucucugaccuuuauuaagacuaccuucagccuucacuaugccuggaaaacaauggccauggugcucuccaucguuucacuguuuccguugugucugagcacuaccagucagaagacgacaugguuaccugugcuccugggcucucuugggugcaagccacugaccauguucuugauagcugagaauaaaaucuggggaaggcgauccuggccccucaacgaagguauuauggcagucggcaucguaagcauucugcuaucgucacugcuuaagaacgaugugccucucgccgggccccugaucgcgggaggcauguugauagcuuguuacguuauuucugguaguuccgccgacuuaagccuggagaaagcagccgaggugucuugggaagaggaagcugagcauagcggggcaucccacaauauccucgucgaagugcaggaugacggaacuaugaagaucaaagaugaggagcgcgacgauacacugaccauucuucugaaggccacuuugcuagcgguaucaggcguguauccacugaguauaccugcuacacucuuugucugguacuucuggcagaagaagaagcagcggagcggcguucugugggacacccccucuccaccggaaguggagagagccgugcuugaugacgggaucuauaggauuaugcagcguggauuacugggucgcucccaggucggcguggggguuuuccaagaaaacguauuucauacgauguggcacgugacucggggagcaguccucauguaccagggcaaaagauuggagccuucaugggccagugugaagaaagaccugaucagcuacggugggggauggaggcuccagggcuccuggaauaccggcgaggaaguucaggugauugcugucgagcccgggaagaaccccaaaaaugugcaaacagcccccggaaccuucaagacaccugaaggugagguaggcgcaaucgcucuggauuuuaagccagggacuucuggaucgcccauagucaaccgagaaggcaaaaucgugggucuuuaugggaauggaguugugaccacgagcggcacauacgucucagccauugcgcaggccaaggcaucccaggagggcccucugccggagaucgaagacgagguguuccggaaacgcaacuugacuauuauggaucuacacccagggaguggaaagaccagaagguaucugcccgcuaucguucgggaagccauaaaacgaaagcucagaacauuaauucuggcuccuacccgcguggucgcaucugagauggccgaagcccuuaaggguaugccaaucagguaccaaacuaccgcugugaaaagcgagcauacaggcaaggagaucguagaccugaugugccacgcgacguuuacuaugcgucucuugucccccgugcggguuccuaauuauaacaugauuaucauggaugaagcacauuucaccgacccgucaucuauagccgcuagaggguacauuagcacaagggucggaaugggcgaggccgcagccaucuuuaugaccgcuacucccccagguaguguggaagcguucccucaguccaaugccgugauucaggaugaggaacgcgacauccccgagcgaagcuggaacucuggguaugaguggauaacagauuuuccaggaaaaaccgucugguucguaccuucaauuaaguccggcaaugacaucgcaaacugucugaggaaaaauggcaagcgggugauccagcucaguaggaagacguuugauacugaauaccagaaaacuaagaacaacgacugggacuacguugugaccaccgauauuagcgagaugggggcuaauuuccgcgccgaccgugucaucgaucccagacggugccugaaaccagugauucuuaaggacggaccggaaaggguuauacuagcagguccuaugcccgugacugucgccucggcugcccaacgccgaggcagaaucgggcggaaccacaauaaagagggagaucaguauauuuacaugggccagccacugaacaaugacgaggaucaugcgcacuggacagaagcaaagauguuguuagacaacaucaauacccccgaggguaucauuccugcccuguucgaaccagagagggaaaagucugcugccauagauggggaguaucgccucagaggcgaggcuaggaaaacauuuguggaacugaugcggcguggagaccuucccguauggcuguccuacaagguggcaagcgagggcuuccaauauucagaucgccgauggugcuuugacggggaaagaaacaaucagguucucgaggaaaacauggaugucgagaucuggacuaaagagggagaaaggaagaaauugcggccucgcuggcuggacgccagaacguacagugacccgcuagcucugagggaguucaaggaauuugccgcaggucggcgaucuguguccggcgaucucauucuugagaucgggaaacugccacagcacuuaacccagagagcgcaaaaugccuuggacaaccuggugaugcuccauaauagcgaacagggaggccgcgcuuauaggcacgccauggaggagcugcccgauacaauugaaacucuuaugcugcucgcauugaucgcuguccugaccggugggguuacauuauucuuucuaucaggccggggacugggcaagaccaguauagggcuccuuugugugauggccagcuccguacuguuguggauggcaucuguggagccucauuggaucgccgcuagcauuauccuggaguucuuucucaugguccugcuuauucccgagccagaccgucagagaacuccucaggauaaccaacucgcguacgugguuaucggacuguuguucaugauacugacgguggccgcaaaugagauggguuuacuagaaaccacaaagaaagaccugggcauugggcacgucgcuguaggaaaccaccaucacgccgccaugcucgauguggaccuucaucccgcauccgcuuggacucuguacgccguugcgaccacaaucauuaccccaaugaugaggcacacuaucgagaacacaacggcuaauauaucauugaccgccaucgcaaaccaggccgcuauucugaugggccucgauaaggguuggccuaucucuaaaauggacauuggggugccgcugcuugcauuaggcugcuauagucaggucaauccccugacucucacagccgcgguguugaugcuggucgcucauuacgccaucauaggaccaggccuacaagcaaaggccacccgcgaagcucagaaacggaccgccgcagggauuaugaagaacccuacaguggauggaaucguugcuaucgaccuggaucccgugguauaugacgccaaguuugagaaacagcucggccagauuaugcuucugaucuuguguacuucgcaaauacugcucaugcgaacgaccugggcgcugugcgaaagcauuacauuagccacugguccacuuaccacacugugggagggguccccuggaaaguucuggaauaccacuaucgcagugucuauggcuaacauuuuuagaggcucauaccucgccggugcaggccuagcuuucagccugaugaaaucccuagggggaggcaggcgcgggacgggagcccagggcgagacacugggugaaaaguggaaacggcagcucaaucagcuuaguaagucugaguucaacaccuauaagagaagcgggaucauggaagucgaccguucagaggccaaagaaggacugaagaggggcgagacuaccaaacacgcgguuucccgggguacagcuaaguugcgcugguuuguggagcgaaaucuggucaaacccgaaggcaaggugauagaucucggguguggaagaggcggguggaguuacuauugcgcaggauuaaagaaaguaacugaggugaagggcuacaccaaaggugggccgggacacgaagaaccaaucccuauggccacauacggcuggaaccugguuaaacuucauagcggcaaagacguguucuuuauucccccagaaaagugugauacgcugcuaugcgacaucggggagucuucccccaauccuaccauugaggaaggaaggacucuccggguccugaaaaugguggagccgugguugcgcgguaaccaauucuguaucaagauucugaaucccuauaugccaucagucguggaaacacucgagcagaugcagagaaagcacggcgggaugcuuguuaggaacccucugagccgaaauucgacccaugagauguacuggguaucuugcggaacuggcaacaucgugagugcugucaauaugacaucccggauguuacugaaccguuuuaccauggcccacagaaaacccacguaugaacgcgauguggacuugggugcagggaccaggcacguugccguggagccugaagucgcuaaccucgauauaauuggacagcggaucgagaauaucaagcaugaacacaaaagcacauggcauuacgacgaggauaacccauauaagacuugggcguaccacggcucauaugaggugaaacccuccggcucugccagcaguaugguaaauggggugguuaagcugcuaaccaagccuugggacgucauuccaauggugacacaaauagcaaugacugauaccacacccuucggacagcagagaguguuuaaagaaaaggucgacacccgcacuccgaaagcuaagagggguacggcccaaaucauggagguuacagcaaaauggcuuuggggcuuccugucccgaaacaagaagccucggauuuguaccagagaagaguuuacuaggaaagugcgcagcaaugccgcuaucggggccguauucguggacgaaaaccaguggaacucugcgaaggaggcagucgaggaugaacguuuuugggaccucgugcaucgggagagagaacugcacaaacagggaaagugcgcaaccugcguuuacaacaugaugggcaaaagggagaagaaguugggugaguucgggaaagcuaagggaucacgcgccauuugguacauguggcugggcgcacgauuucucgaguucgaggcucuuggcuucaugaaugaagaucacugguuuagucgggagaacucccugagcgggguggaaggagaggguuuacauaaacugggcuauaucuugagagacauaucuaagaucccagggggaaauauguacgccgaugacacagcuggcugggauacgaggauuaccgaggacgaucuccagaacgaagcccgcaucacugacauuauggagcccgaacacgcacugcuagcgaaaucgaucuucaaacuuacauaucaaaauaaagucgugagaguacagcggccugccaagaacgguaccguuauggaugugauaucaaggcgugaccagcgagggagcggacaggucggcacuuacggccugaauacauuuaccaacauggaggcucaacucauucgccagauggaauccgaggggaucuucaguccaucugagcuggaaacacccaacuuggccgagagaguguuagauuggcuggaaaaguauggaguggagcggcucaaaaggauggcaaucagcggugacgacugugucguuaagccgauugaugaccgcuuugcuacugcccuuaccgcacugaaugauaugggcaaagugagaaaggacauaccucagugggaacccuccaaaggguggaacgauuggcagcaaguaccauucugcucacaucacuuucaccagcuaaucaugaaggacggacgggagauuguggucccuuguaggaaucaggaugagcuggugggccgagcccguguuagucagggugcgggguggucucucagagaaacggcuugcuugggaaagagcuacgcccaaauguggcagcugauguauuuccaucgccgggaccuuaggcuggcagccaacgcuaucuguuccgccgugcccgucgauuggauuccaaccucaagaacaacuuggagcauccacgcacaucaccaguggaugaccacagaggacaugcucucuguguggaaucgcguauggauagaagagaaccccuggauggaagauaaaacucauaucuccaguuggggcgacguuccuuacuuaggcaagcgggaggaccaauggugcgggagccugauuggauugaccgcuagggccacgugggcgacaaauauccagguggcuauuaaccagguccgaagacugaucgguaaugagaacuaccucgauuauaugaccucgaugaaacgguuuaagaaugaauccgacccagagggcgcccuuugguga

SEQ ID NO: 13320 - RNA, 9879 nt, Artificial Sequence
  derived and/or modified CDS sequence (opt3) from DENV-1__HM181955__SS-prME
agcgugaccaugcugcucaugcuuaugcccacugcacuggcuuuccacuugacuacgcggggaggggagccucauaugaucgucuccaagcaggaaagaggaaaaucuuuacuguuuaagaccucagccgguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagucggccuggaaacagauccagaggguggaaacuugggcucuccggcacccuggguucaccguuauugcacuguuucuggcccaugcuaucggaacaucaauuacccagaagggcaucauauucauccucuuaaugcuggugacgccaagcauggccaugcgcugcgucggcauugggaguagagauuuuguggagggacuuuccggugcgacuuggguagacguuguguuggagcacggcucuugugucacaaccauggcaaaggauaaacccacucuggacaucgaacuacucaagacagaggugaccaacccugccauucugaggaaacuuugcaucgaagcuaagauaagcaauacgaccacagauucccgguguccaacucaaggggaggccacccugguggaagaacaagacgcaaacuucgucugccgccgaacauuuguugauagaggauggggcaaugguuguggguuguucggaaaaggcucacucauuacuugcgcuaaguuuaagugcgugaccaaacuggagggcaagaucguacaguacgaaaacuuaaaauauagugugauugucacagugcacaccggggaccagcaucaaguuggaaaugagagcacugaacacgguacgacagccaccaucacuccccaggcgccuaccacagagauccagcugaccgacuacggcgcccucacucuugauuguucuccaaggacagggcuggacuucaacgaaaugguguugcuaacgaugaaggagaaauccuggcugguccauaagcagugguuucucgaucugccgcuucccuggaccucaggagcaagcacaagucaagagacauggaaucggcaggaccuguuggugaccuucaaaacagcucacgccaagaagcaggaaguaguugugcucggcucucaagagggugcuaugcacacugcccugaccggggcaacggaaauucagaccuccggcacaacuaccauauuugccggacauuuaaaaugccgucugaagauggauaaacuaacacucaagggcaugagcuaugucauguguacugggucguucaaacuggagaaggaaguggcugagacccagcacggaacgguccuugugcagaucaaguacgaggguacagacgcgccuugcaaaauuccauucucuacccaagaugaaaagggcguuacucagaacgggcgcuugaucacagcaaaucccauagugaccgacaaagagaagccuguaaacauugaagccgagccacccuuuggagaguccuauaucgucaucggcgcuggugaaaaagcccugaagcucucaugguucaagaaagggaguagcauuggcaagauguuugaggcaacugccagaggagcuaggcggauggccauccugggcgauaccgcaugggacuucggguccauuggagguguguuuacaucuguuggcaaacuugugcaucagauauucgggacggcguacggaguccuguuuagcggcgugucauggaccaugaagaucgguauugggguauugcucacuuggcugggcuuaaauagucgauccacaagccugucuaugaccuguaucgcugugggccuaguuacacucuaccugggcgucauggugcaggccgauucagggugcgugaucaacuggaaaggacgcgaacuuaaguguggcagugguauuuucgucacuaaugagguucacaccuggacggaacaauauaaguuucaggcagacagcccgaaaagauuguccgccgcuauagggaaggccugggaggagggagugugcggcaucaggucugcaacacggcuggaaaacauuauguggaaacagaucucgaacgagcucaaucauauucuguuagaaaacgacaugaaguucaccgugguagucggugauguggcuggcauccuggcccaggggaaaaagaugauacgcccucaacccauggaguacaaauauagcuggaaguccuggggaaaggcgaaaaucauuggcgccgacguucagaauacuaccuuuaucauugaugggccaaacacaccugaaugucccgacgaucagagagcuuggaauaucugggagguggaggacuacggauucggcauauuuacuaccaacauuuggcuuaaguugagggauucauauacacaggucugcgaccaccgucucaugagugcagccaucaaagauucuaaggcugugcacgccgacauggguuacuggauugaaagcgagaaaaaugaaacguggaagcuggcacgggcguccuucaucgagguuaagaccuguauauggccaaaaucacauacucuauggagcaacggggugcuggaaucugagaugaucauucccaagaucuauggaggcccuauuucccaacacaauuaccgaccagguuacuucacacagaccgccggcccguggcaucucgggaaacuggagcuugauuuugacuugugcgaaggaacuacaguagucguggaugagcacugcggcaacagagggcccagucugaggaccacgacugugaccggaaagaucauacacgaaugguguugccgcagcuguacauuaccuccacuccgguucagaggcgaggacgguugcugguaugggauggagauuaggcccgucaaagaaaaggaggaaaaucugguuaagucuaugguguccgcuggaucaggcgagguagacaguuuuagccuuggucuguuguguaucucgaucaugauugaagaggugaugcgcucccgauggucucggaaaaugcucaugaccggcacucuggucguguuccuacugcucaucauggggcagcugacauggaacgaucuuauucguuugugcauaaugguuggagccaaugcaagcgacagaaugggcauggggaccacauaccuggcuuuaauggccacuuuuaagaugaggccuauguucgcagugggacuccuguuucgccggcuuaccucaagagagguccugcuacucacgaucggccugaguuugguggccuccguugaacugccaaacucuuuagaggaacucggugaugggcuggcuaugggaauuaugauccuuaaacuguugacagacuuccaaagccaucagcucugggcgacccugcuaucccugacuuuuauuaagaccacauucucacuucacuaugccuggaaaacuauggcaauggugcucagcaucgucagucuguuucccuugugucugucuaccacgucccagaagacaaccugguuaccgguacuccugggcagccuuggcugcaagccucugacuauguucuugauagcugagaauaaaaucugggggaggcgaucguggccacucaacgaaggaauuauggccguggguaucguuucaauucugcuaucuagucugcuuaagaacgaugugccccucgccggcccucugaucgcugggggaauguugauagcauguuacgucauuuccggcagcucugccgacuuaagccuggagaaagcggcugagguguccugggaagaggaagccgagcauucaggugcaagucacaauauccucguagaagugcaggaugacgggacaaugaagaucaaagaugaggagcgcgacgauacccugacuauucuucugaaggccacauugcuagcugucagcggaguuuauccccugucuauaccagcaacccucuuugugugguacuucuggcagaagaagaagcagcgguccggcgugcugugggacacgccuucacccccagaagucgagagagccgugcuugaugacggcaucuauaggauuaugcagcguggguuacugggacgcagucagguugguguaggcguguuccaagaaaacgucuuucauacuauguggcacgugaccagaggggcgguucucauguaccagggaaaaagauuggagccgagcugggcuuccgugaagaaagaccugaucucuuacggcgguggguggaggcuccagggaucguggaauacaggcgaggaaguccaggugauugccguagagccuggcaagaaccccaaaaauguccaaaccgcaccagggacauucaagacucccgaaggagaggugggugccaucgcucuggauuuuaagccuggcaccagcgggucaccaauaguuaaccgagaaggaaaaaucgugggccuuuaugguaauggggucgugacgacauccggaacuuacguuagugccauugcacaggcuaaggccucucaggagggcccccugccugagaucgaagacgagguguuccggaaacgcaacuugaccauuauggaucuacacccgggcagcgggaagacaagaagguaucugccagcgaucguccgggaagccauaaaacgaaagcucagaaccuuaauucuggcacccacucgcgugguagcuuccgagauggccgaagcucuuaagggaaugccuaucagguaccaaaccacagcagugaaaucagagcauacggguaaggagaucguugaccugaugugccacgccacuuuuaccaugcgucucuugucuccaguccgggugcccaauuauaacaugauuaucauggaugaagcccauuucacagacccuagcaguauagcugcgagaggcuacauuuccaccaggguggggaugggagaggcagccgcuaucuuuaugacugccacaccgcccggcagcgucgaagcauucccacagucuaaugccguaauucaggaugaggaacgcgacaucccugagcgaucauggaacuccgguuaugaguggauaaccgauuuucccgggaaaacggugugguucguuccaaguauuaagagcggaaaugacaucgcuaacugucugaggaagaauggcaagcgggugauccagcucucgaggaagacuuuugauacagaauaccagaaaaccaagaacaacgacugggacuacgucgugaccacugauauuucugagaugggcgcgaauuuccgcgccgaccguguuaucgauccuagacggugccugaaacccgugauucuuaaggacgggccagaaagggucauacuagcaggaccgaugccugugacaguagcuuccgccgcacagcgccgagguagaaucggccggaaccacaauaaagagggggaucaguauauuuacaugggacagccccugaacaaugacgaggaucaugcccacuggaccgaagcuaagauguuguuagacaacaucaauacaccagagggcaucauucccgcccuguucgaaccugagagggaaaagagcgcggcaauagauggugaguaucgccucagaggggaggccaggaaaacuuuuguggaacugaugcggcguggcgaccuuccaguuuggcugucauacaaggucgcuagugagggauuccaauauucugaucgccgauggugcuuugacggcgaaagaaacaaucaggugcucgaggaaaacauggauguggagaucuggacgaaagagggggaaaggaagaaauugcggccccgcuggcuggacgccagaaccuacuccgacccucuagcucugagggaguucaaggaauuugcagccggacggcgaagcgucucaggugaucucauucuugagaucggcaaacugccgcagcacuuaacacagagagcucaaaaugccuuggacaaccugguuaugcuccauaauagugaacaaggcgggcgcgcauauaggcacgcgauggaggagcugccagauacuauugaaacccuuaugcugcucgccuugaucgcugugcugacaggggguguaaccuuauucuuucuaagcgggcggggccugggaaagacuuccauaggccuccuuugugugauggccucuagcguccuguuguggauggcauccguggagccccauuggaucgcugccucaauuauccuggaguucuuucucaugguucugcuuauuccugagcccgaccgucagagaacgccacaggauaaccaacucgcauacguggucaucgggcuguuguucaugauacugaccguagccgcuaaugagaugggauuacuagaaacaacuaagaaagaccuggguauuggccacguggcgguugggaaccaccaucacgccgcaaugcucgauguggaccuucauccugcuucugccuggacccuguacgccgucgcaacaaccaucauuacucccaugaugaggcacacaaucgagaacacgaccgcuaauauaaguuugacugccaucgcgaaccaggcugccauucugaugggacucgauaagggcuggccaaucucgaaaauggacauuggugugccucugcuugcauuagggugcuauagccaggucaauccgcugacacucaccgccgcuguguugaugcugguugcacauuacgccaucauaggccccggacuacaagcgaaggcuacccgcgaagcccagaaacggacagcagccggcauuaugaagaacccaacuguggaugggaucguagcuaucgaccuggauccuguggucuaugacgccaaguuugagaaacagcucggacagauuaugcuucugaucuuguguacgucccaaauacugcucaugcgaaccacaugggcacugugcgaaucuauuacuuuagcuaccggcccccuuacaacccugugggaggguucaccagggaaguucuggaauacuacgaucgccguuagcauggcgaacauuuuuagaggauccuaccucgccggcgcaggucuagcuuucagucugaugaaaucuuugggcgggggaaggcgcggcacaggggcccagggagagacccugggcgaaaaguggaaacggcagcucaaucagcuuagcaagucagaguucaacacuuauaagagauccgguaucauggaaguggaccguagugaggcaaaagaagggcugaagaggggagagaccacaaaacacgcugucagccggggcacugccaaguugcgcugguuuguggagcgaaaucugguaaaaccugaagguaaggugauagaucucggcugugggagaggaggcuggucuuacuauugcgccggguuaaagaaaguuaccgaggugaagggauacacaaaaggcggucccgggcacgaagaaccgaucccaauggcgacguacggauggaaccuggucaaacuucauuccggcaaagacguguucuuuauuccucccgaaaagugugauacccugcuaugcgacaucggcgagucaagcccaaaucccacuauugaggaagggaggacacuccggguccugaaaaugguggagccuugguugcgcggaaaccaauucuguaucaagauucugaauccguauaugcccucgguuguagaaacccucgagcagaugcagagaaagcacgguggcaugcuugugaggaacccacugucucgaaauaguacucaugagauguacugggucuccugcgggacaggaaacaucgugagcgcuguuaauaugaccucacggauguuacugaaccguuuuacgauggcacacagaaaaccuaccuaugaacgcgauguggacuugggcgccgguacaaggcacgucgcuguggagcccgaaguagccaaccucgauauaauugggcagcggaucgagaauaucaagcaugaacacaaauccacuuggcauuacgacgaggauaacccuuauaagaccugggcauaccacggaucuuaugaggugaaaccaagcggcagugccuccagcaugguuaauggcgucgugaagcugcuaacaaagcccugggacgugauuccuauggucacucaaauagcuaugaccgauacaaccccauucgggcagcagagaguuuuuaaagaaaagguggacacucgcacgcccaaagcgaagaggggaacagcccaaaucauggagguaaccgcaaaauggcuuugggguuuccugucucgaaacaagaagccgcggauuuguacuagagaagaguuuaccaggaaagugcgcucaaaugcugccaucggcgcagucuucguggacgaaaaccaguggaauagugccaaggaggcuguugaggaugaacguuuuugggaccucgugcaucgggagagagaacugcacaaacaggggaagugcgccacaugcgucuacaacaugaugggaaaaagggagaagaaguugggcgaguucgguaaagcgaaggggucccgcgcaauuugguacauguggcugggagcccgauuucucgaguucgaggcucuuggcuucaugaaugaagaucacugguuuagccgggagaacucucugucgggcguggaaggggagggauuacauaaacuggguuauaucuugagagacauaucaaagaucccuggcgggaauauguacgccgaugacacggcaggaugggauaccaggauuacugaggacgaucuccagaacgaagcucgcaucacagacauuauggagccagaacacgcccugcuagcuaaaagcaucuucaaacuuaccuaucaaaauaaaguaguuagagugcagcggcccgccaagaacggcacugucauggaugugauauccaggcgugaccagcgagguaguggacaggugggaacauacggccugaauaccuuuacaaacauggaggcacaacucauucgccagauggaaucugagggcaucuucagcccuuccgagcuggaaacuccaaacuuggcggagagagucuuagauuggcuggaaaaguaugggguugagcggcucaaaaggauggccaucucaggagacgacugugugguaaagcccauugaugaccgcuuugcuaccgcccuuacggcacugaaugauauggguaaagugagaaaggacauaccgcagugggaaccuaguaaaggcuggaacgauuggcagcaaguccccuucugcucucaucacuuucaccagcuaaucaugaaggacgggcgggagauugugguuccauguaggaaucaggaugagcuggugggacgagcucgugucagccagggcgccgguuggucccucagagaaaccgcaugcuuggggaagucauacgcccaaauguggcagcugauguauuuccaucgccgggaccuuaggcuggcggcuaacgccaucuguagcgcagugccuguagauuggauucccacaucuagaacuaccugguccauccacgcccaucaccaguggaugacaacugaggacaugcucaguguuuggaaucgcguguggauagaagagaacccauggauggaagauaaaacccauaucagcucguggggagacguccccuacuuaggcaagcgggaggaccaauggugcggcucccugauuggguugacggcuagggccacaugggcaaccaauauccagguggcuauuaaccagguucgaagacugaucggaaaugagaacuaccucgauuauaugacuucuaugaaacgguuuaagaaugaaucagacccugagggugcccuuugguga

SEQ ID NO: 13321 - RNA, 9879 nt, Artificial Sequence
  derived and/or modified CDS sequence (opt3) from DENV-1__HM181959__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagucggccuggaaacagauccagaggguggaaacuugggcucuccggcacccuggguucaccguuauugcacuguuucuggcccaugcuaucggaacaucaauuacccagaagggcaucauauucauccucuuaaugcuggugacgccaagcauggccaugcgcugcgucggcauugggaguagagauuuuguggagggacuuuccggugcgacuuggguagacguuguguuggagcacggcucuugugucacaaccauggcaaaggauaaacccacucuggacaucgaacuacucaagacagaggugaccaacccugccauucugaggaaacuuugcaucgaagcuaagauaagcaauacgaccacagauucccgguguccaacucaaggggaggccacccugguggaagagcaggacgcaaacuucgucugccgccgaacauuuguugauagaggauggggcaaugguuguggguuguucggaaaaggcucacucauuacuugcgcuaaguuuaagugcgugaccaaacuggagggcaagaucguacaguacgaaaacuuaaaauauagugugauugucacagugcacaccggggaccagcaucaaguuggaaaugagagcacugaacacgguacgacagccaccaucacuccccaggcgccuaccacagagauccagcugaccgacuacggcgcccucacucuugauuguucuccaaggacagggcuggacuucaacgaaaugguguugcuaacgaugaaggagaaauccuggcugguccauaagcagugguuucucgaucugccgcuucccuggaccucaggagcaagcacuagucaagagacauggaaucggcaggaccuguuggugaccuucaaaacagcucacgccaagaagcaggaaguaguugugcucggcucucaagagggugcuaugcacacugcccugaccggggcaacggaaauucagaccuccggcacaacuaccauauuugccggacauuuaaaaugccgucugaagauggauaaacuaacacucaagggcaugagcuaugucauguguacugggucguucaaacuggagaaggaaguggcugagacccagcacggaacgguccuugugcagaucaaguacgaggguacagacgcgccuugcaaaauuccauucucuacccaagaugaaaagggcguuacucagaacgggcgcuugaucacagcaaaucccauagugaccgacaaagagaagccuguaaacauugaagccgagccacccuuuggagaguccuauaucgucaucggcgcuggugaaaaagcccugaagcucucaugguucaagaaagggaguagcauuggcaagauguuugaggcaacugccagaggagcuaggcggauggccauccugggcgauaccgcaugggacuucggguccauuggagguguguuuacaucuguuggcaaacuugugcaucagauauucgggacggcguacggaguccuguuuagcggcgugucauggaccaugaagaucgguauugggguauugcucacuuggcugggcuuaaauagucgauccacaagccugucuaugaccuguaucgcugugggacuaguuacacucuaccugggcgucauggugcaggccgauucagggugcgugaucaacuggaaaggacgcgaacuuaaguguggcagugguauuuucgucacuaaugagguucacaccuggacggaacaauauaaguuucaggcagacagcccgaaaagauuguccgccgcuauagggaaggccugggaggagggagugugcggcaucaggucugcaacacggcuggaaaacauuauguggaaacagaucucgaacgagcucaaucauauucuguuagaaaacgacaugaaguucaccgugguagucggugauguggcuggcauccuggcccaggggaaaaagaugauacgcccucaacccauggaguacaaauauagcuggaaguccuggggaaaggcgaaaguuaucggcgccgacgugcagaauacuaccuuuauuaucgaugggccaaacacaccugaaugucccgacgaucagagagcuuggaauauuugggaggucgaggacuacggauucggcaucuuuacuaccaacauauggcuuaaguugagggauucauauacacaggugugcgaccaccgucucaugagugcagccauuaaagauucuaaggcuguucacgccgacauggguuacuggaucgaaagcgagaaaaaugaaacguggaagcuggcacgggcguccuucauugaggugaagaccuguaucuggccaaaaucacauacucuauggagcaacgggguacuggaaucugagaugauaauccccaagauuuauggaggcccuaucucccaacacaauuaccgaccagguuacuucacacagaccgccggcccguggcaucucgggaaacuggagcuugauuuugacuugugcgaaggaacuacagucgugguggaugagcacugcggcaacagagggcccagucugaggaccacgacugucaccggaaagauuauccacgaaugguguugccgcagcuguacauuaccuccacuccgguucagaggcgaggacgguugcugguaugggauggagauaaggcccguuaaagaaaaggaggaaaaucuggugaagucuaugguauccgcuggaucaggcgagguggacaguuuuagccuuggucuguuguguauuucgaucaugaucgaagaggucaugcgcucccgauggucucggaaaaugcucaugaccggcacucuggugguuuuccuacugcucauuauggggcagcugacauggaacgaucuuauccguuugugcauuauggugggagccaaugcaagcgacagaaugggcauggggaccacauaccuggcuuuaauggccacuuuuaagaugaggccuauguucgcagucggacuccuguuucgccggcuuaccucaagagaggugcugcuacucacgauaggccugaguuugguugccuccguggaacugccaaacucuuuagaggaacucggugaugggcuggcuaugggaaucaugauucuuaaacuguugacagacuuccaaagccaucagcucugggcgacccugcuaucccugacuuuuaucaagaccacauucucacuucacuaugccuggaaaacuauggcaaugguccucagcauuguaagucuguuucccuugugucugucuaccacgucccagaagacaaccugguuaccggugcuccugggcagccuuggcugcaagccucugacuauguucuugaucgcugagaauaaaauaugggggaggcgaucguggccacucaacgaaggaaucauggccguugguauugugucaauccugcuaucuagucugcuuaagaacgaugucccccucgccggcccucugauugcugggggaauguugaucgcauguuacgugauauccggcagcucugccgacuuaagccuggagaaagcggcugagguauccugggaagaggaagccgagcauucaggugcaagucacaauauucucguggaaguccaggaugacgggacaaugaagaucaaagaugaggagcgcgacgauacccugacuauccuucugaaggccacauugcuagcuguuagcggaguguauccccugucuauuccagcaacccucuuugugugguacuucuggcaaaaaaagaagcagcgguccggcguccugugggacacgccuucacccccagaaguggagagagccguucuugaugacggcauauauaggaucaugcagcguggguuacugggacgcagucagguaggugugggcgucuuccaagaaaacguguuucauacuauguggcacguuacccggggggcggugcucauguaccagggaaaaagauuggagccgagcugggcuuccgucaagaaagaccugauuucuuacggcgguggguggaggcuccagggaucguggaauacaggcgaggaagugcagguaaucgccgucgagccuggcaagaaccccaaaaaugugcaaaccgcaccagggacauucaagacucccgaaggagagguuggugccauugcucuggauuuuaagccuggcaccagcgggucaccaaucgugaaccgagaaggaaaaauagucggccuuuaugguaauggggugguuacgacauccggaacuuacgugagugccaucgcacaggcuaaggccucucaggagggcccccugccugagauugaagacgaggucuuccggaaacgcaacuugaccaucauggaucuacacccgggcagcgggaagacaagaagguaucugccagcgauugugcgggaagccaucaaacgaaagcucagaaccuuaauacuggcacccacucgcguaguggcuuccgagauggccgaagcucuuaagggaaugccuauuagguaccaaaccacagcaguuaaaucagagcauacggguaaggagaucgucgaccugaugugccacgccacuuuuaccaugcgucucuugucuccagugcgggugcccaauuauaacaugaucauuauggaugaagcccauuucacagacccuagcaguaucgcugcgagaggcuacauauccaccagggucgggaugggagaggcagccgcuauuuuuaugacugccacaccgcccggcagcguagaagcauucccacagucuaaugccgugauccaggaugaggaacgcgacauuccugagcgaucauggaacuccgguuaugaguggaucaccgauuuucccgggaaaacgguuugguucgugccaaguauaaagagcggaaaugacauugcuaacugucugagaaaaaauggcaagcgggucauccagcucucgaggaagacuuuugauacagaauaccaaaaaaccaagaacaacgacugggacuacgugguuaccacugauaucucugagaugggcgcgaauuuccgcgccgaccgugugauugauccuagacggugccugaaacccgucauccuuaaggacgggccagaaagggugauucuagcaggaccgaugccuguaacaguggcuuccgccgcacagcgccgagguagaauaggccggaaccacaauaaagagggggaucaguauaucuacaugggacagccccugaacaaugacgaggaucaugcccacuggaccgaagcuaagauguuguuagacaacauuaauacaccagagggcaucauccccgcccuguucgaaccugagagggaaaagagcgcggcaauugauggugaguaucgccucagaggggaggccaggaaaacuuuuguugaacugaugcggcguggcgaccuuccagucuggcugucauacaagguggcuagugagggauuccaauauucugaucgccgauggugcuuugacggcgaaagaaacaaucaggugcucgaggaaaacauggaugucgagauauggacgaaagagggggaaaggaagaaauugcggccccgcuggcuggacgccagaaccuacuccgacccucuagcucugagggaguucaaggaauuugcagccggacggcgaagcguuucaggugaucucauccuugagauuggcaaacugccgcagcacuuaacacagagagcucaaaaugccuuggacaaccuggugaugcuccauaauagugaacaggggggacgcgcauauaggcacgcgauggaggagcugccagauacuaucgaaacccuuaugcugcucgccuugauugcuguacugacaggcggugugaccuuauucuuucuaagcgggcggggccugggaaagacuuccaucggccuccuuugugucauggccucuagcgugcuguuguggauggcauccguugagccccauuggauagcugccucaaucauucuggaauucuuucucauggugcugcuuaucccugagcccgaccgucagagaacgccacaggauaaccaacucgcauacgucguaauugggcuguuguucaugauccugaccguggccgcuaaugagaugggauuacuagaaacaacuaagaaagaccuggguauaggccacguugcgguggggaaccaccaucacgccgcaaugcucgaugucgaccuucauccugcuucugccuggacccuguacgccguggcaacaaccauuaucacucccaugaugaggcacacaauugagaacacgaccgcuaauaucaguuugacugccauagcgaaccaggcugccauccugaugggacucgauaagggcuggccaauuucgaaaauggacaucggugucccucugcuugcauuagggugcuauagccaggugaauccgcugacacucaccgccgcuguuuugaugcugguggcacauuacgccauuaucggccccggacuacaagcgaaggcuacccgcgaagcccagaaacggacagcagccggcauaaugaagaacccaacuguagaugggauuguggcuaucgaccuggauccugucguuuaugacgccaaguuugagaaacagcucggacagaucaugcuucugauuuuguguacgucccaaauccugcucaugcgaaccacaugggcacugugcgaaucuauaacuuuagcuaccggcccccuuacaacccugugggaggguucaccagggaaguucuggaauacuacgauugccgugagcauggcgaacaucuuuagaggauccuaccucgccggcgcaggucuagcuuucagucugaugaaaucuuugggcgggggaaggcgcggcacaggggcccagggagagacccugggcgaaaaguggaaacggcagcucaaucagcuuagcaagucagaguucaacacuuauaagagauccgguauuauggaagucgaccguagugaggcaaaagaagggcugaagaggggagagaccacaaaacacgcugugagccggggcacugccaaguugcgcugguuuguagagcgaaaucuggugaaaccugaagguaagguuaucgaucucggcugugggagaggaggcuggucuuacuauugcgccggguuaaagaaagugaccgaggucaagggauacacaaaaggcggucccgggcacgaagagccgauaccaauggcgacguacggauggaaccuggugaagcuucauuccggcaaagacgucuucuuuaucccucccgaaaagugugauacccugcuaugcgacauuggcgagucaagcccaaaucccacuaucgaggaagggaggacacuccgggugcugaaaaugguugagccuugguugcgcggaaaccaauucuguauuaagauccugaauccguauaugcccucgguaguggaaacccucgagcagaugcagagaaagcacgguggcaugcuugucaggaacccacugucucgaaauaguacucaugagauguacuggguguccugcgggacaggaaacauuguuagcgcugugaauaugaccucacggauguuacugaaccguuuuacgauggcacacagaaaaccuaccuaugaacgcgaugucgacuugggcgccgguacaaggcacguggcuguagagcccgaaguggccaaccucgauaucauagggcagcggauugagaauaucaagcaugaacacaaauccacuuggcauuacgacgaggauaacccuuauaagaccugggcauaccacggaucuuaugagguuaaaccaagcggcagugccuccagcauggucaauggcguggugaagcugcuaacaaagcccugggacgucaucccuaugguuacucaaauugcuaugaccgauacaaccccauucgggcagcagagaguguuuaaagaaaagguagacacucgcacgcccaaagcgaagaggggaacagcccaaauaauggaggugaccgcaaaauggcuuugggguuuccugucucgaaacaagaagccgcggaucuguacuagagaagaguuuaccaggaaaguccgcucaaaugcugccauuggcgcaguguucguugacgaaaaccaguggaauagugccaaggaggcuguggaggaugaacguuuuugggaccucguccaucgggagagagaacugcacaaacaggggaagugcgccacaugcguguacaacaugaugggaaaaagggagaagaaguugggcgaauucgguaaagcgaaggggucccgcgcaaucugguacauguggcugggagcccgauuucucgaguucgaggcucuuggcuucaugaaugaagaucacugguuuagccgggagaacucucugucgggcguagaaggggagggauuacauaaacuggguuauauuuugagagacaucucaaagauaccuggcgggaauauguacgccgaugacacggcaggaugggauaccaggaucacugaggacgaucuccagaacgaagcucgcauuacagacaucauggagccagaacacgcccugcuagcuaaaagcauuuucaagcuuaccuaucaaaauaaaguugugagaguccagcggcccgccaagaacggcacugugauggaugugaucuccaggcgugaccagcgagguagugggcaggucggaacauacggccugaauaccuuuacaaacauggaggcacaacucauacgccagauggaaucugagggcauuuucagcccuuccgagcuggaaacuccaaacuuggcggagagaguuuuagauuggcuggaaaaguaugggguggagcggcucaaaaggauggccaucucaggagacgacuguguagugaagcccaucgaugaccgcuuugcuaccgcccuuacggcacugaaugauauggguaaagucagaaaggacauuccgcagugggaaccuaguaaaggcuggaacgauuggcagcaagugcccuucugcucucaucacuuucaccagcuaauaaugaaggacgggcgggagaucguugugccauguaggaaucaggaugagcuggucggacgagcucgugugagccagggcgccgguuggucccucagagaaaccgcaugcuuggggaagucauacgcccaaauguggcagcugauguauuuccaucgccgggaccuuaggcuggcggcuaacgccauuuguagcgcaguaccuguugauuggauccccacaucuagaacuaccugguccauucacgcccaucaccaguggaugacaacugaggacaugcucaguguguggaaucgcgucuggaucgaagagaacccauggauggaagauaaaacccauauaagcucguggggagacgugcccuacuuaggcaagcgggaggaccaauggugcggcucccugaucggguugacggcuagggccacaugggcaaccaauauucagguugcuaucaaccaggugcgaagacugauuggaaaugagaacuaccucgauuauaugacuucuaugaaacgguuuaagaaugaaucagacccugagggugcccuuugguga

SEQ ID NO: 13322 - RNA, 9879 nt, Artificial Sequence
  derived and/or modified CDS sequence (opt3) from DENV-1__JF937651__SS-prME
agcgugaccaugcugcucaugcuuaugcccacugcccuggcuuuccacuugacuacgagaggaggggagccucauaugaucuuauccaagcaagaaaggggaaaaucucugcuguuuaagaccucagcgggugucaauaugugcacacucauugccauggaccugggagagcuuugugaagauacuaugaccuacaaaugcccacggauaacagaggcggaaccggacgauguugacuguuggugcaaugcuaccgauacuugggugacauaugggaccuguagucaaacgggagagcaccgccgagacaagcguagcguggcccuggcaccccaugugggauugggucucgagacuagaaccgaaacauggauguccucugagggggccuggaaacagauccagagggucgaaacuugggcucugcggcacccuggauucaccgugauugcacuguuucucgcccaugcuaucggcacaucgauuacccagaagggcaucauauucaucuuacugaugcuuguuacgccaucaauggccaugcgcugcguggggauuggaagcagagauuuugucgaggguuugaguggcgcgacuuggguggacguaguucuggagcacggguccugugugacaaccauggcaaaggauaaacccacucuggacaucgaacuccugaagacagaggucaccaacccugccauucuuaggaaacugugcaucgaagcuaagauaucuaauacgaccacagauagccgguguccaacucaaggagaggccaccuugguggaagaacaagacgcaaacuucgugugccgccgaacauuugucgauagaggcugggguaauggguguggacucuucggcaaaggcucccugauuacuugcgcuaaguuuaagugcguuaccaaauuagaggggaagaucgugcaguacgaaaaccugaaauauucaguaauugugacaguccacaccggagaccagcaucaaguggguaaugagaguacugaacacggcacgacagccaccaucacuccccaggcgccuaccacagagauccagcucaccgacuacggggcccuuacucuggauuguagcccaaggacaggauuggacuucaacgaaaugguucuacugacgaugaaggagaaaucuuggcucgugcauaagcagugguuucuggaucuuccgcugcccuggaccuccggcgcaucaacuagccaagagacauggaaucggcaggacuugcucgucaccuucaaaacagcucacgccaagaagcaggaagugguaguucuggguagucaagagggggcuaugcacacugccuuaaccggcgcaacggaaauucagaccucuggaacaacuaccauauuugccggccaucugaaaugccgucuaaagauggauaaacucacacugaaggggauguccuaugugauguguacuggcagcuucaaacuugagaaggaagucgcugagacccagcacgguacgguguugguccagaucaaguacgagggcacagacgcgccuugcaaaauuccauucucgacccaagaugaaaagggggugacucagaacggacgccugaucacagcaaaucccauaguuaccgacaaagagaagccugugaacauugaagccgagccacccuuuggcgagucuuauaucguaaucggugcuggggaaaaagcccucaagcuguccugguucaagaaaggcucaaguauuggaaagauguuugaggcaacugccagaggcgcuaggcggauggccauccuuggggauaccgcaugggacuucggaagcauugguggcgucuuuacauccguggggaaacugauacaucagaucuucggaacggcguacggcguuuuguuuucuggugugagcuggaccaugaagauugggaucggcguccuccugacuugguuaggacuaaauucacgaaguacaucccuaagcaugaccuguaucgcugugggccucguaacacuguaccuuggggugaugguucaggccgauucuggaugcgucauuaacuggaaaggccgcgaauugaagugugguucagggauauucgugacuaaugaggugcacaccuggacggaacaauauaaguuucaggcagacaguccgaaaagacugagcgccgcuaucggaaaggccugggaggagggcgucugcgguauuagguccgcaacacggcucgaaaacaucauguggaaacagauuucuaacgagcugaaucauaucuuacuggaaaacgacaugaaguucaccguuguggugggcgauguagcugggauacuugcccagggcaaaaagaugauccgcccucaacccauggaguacaaauauucguggaaaagcuggggcaaggcgaagauuaucggggccgacguccagaauacuaccuuuauuaucgauggaccaaacacaccugaaugucccgacgaucagagagcuuggaauauaugggagguggaggacuacggcuucgguauuuuuacuaccaacaucugguugaagcucagggauuccuauacacagguuugcgaccaccgucugaugucagcagccauuaaagauaguaaggcugugcacgccgacaugggguacuggaucgaaucugagaaaaaugaaacguggaagcuagcacgggcgagcuucauagaggucaagaccuguaucuggccaaaaucccauacucuguggucaaacggagugcucgaaagcgagaugauuauccccaagauuuauggcgguccuaucucucaacacaauuaccgaccaggcuacuucacacagaccgccgggccguggcaucugggaaaacuugaguuggauuuugaccugugcgaaggcacuacaguugugguagaugagcacugcgggaacagaggacccuccuuaaggaccacgacugucaccggcaagauaauucacgaaugguguugccgcaguuguacacucccuccacugcgguucagaggugaggacgggugcugguauggaauggagaucaggcccgugaaagaaaaggaggaaaaucuuguaaagagcauggucucugcuggcuccggugagguugacucauuuagucugggcuugcucuguaucagcauuaugaucgaagaggugaugcgcucgcgauggucccggaaaaugcugaugaccgggacucuagccguauuccugcuccugauuaugggacagcuuacauggaacgauuugauacgucugugcaucauggugggcgcaaaugcuugugacagaauggggaugggaaccacauacuuagcccucauggcaacuuuuaagaugaggccuauguucgccgucggccugcuuuuucgccggcugaccucuagagaggugcuacuccugacgauugguuugagccugguugcuucaguggaauuaccaaacagucucgaggaacugggggauggacuugcgaugggcaucaugauucugaaauugcucacagacuuccaauccuaucagcugugggccacccuacugucucuuacuuuuaucaagaccacauucagccuccauuacgcauggaaaacuauggcuaugguccuguccauagugucauuguuuccccugugcuuaagcaccacgagucagaagacaaccuggcucccgguucugcuuggcucucugggguguaagccuuugacuauguuccucaucgccgagaauaaaauuuggggaaggcgauccuggccacugaacgaagguaucauggccgugggcauugucagcauccuacugucgucacuucucaagaacgauguaccccuggcugggccuuugauagcaggaggcauguuaauugccugcuaugugaucucugguaguuccgcggaccugagccucgagaaagcugccgagguuucuugggaagaggaagcagagcacagcggggccucccauaauauccugguggaaguccaggaugacggaacaaugaagauuaaagaugaggagcgcgacgauacccuuacuauacuguugaaggcuacacuacuggcagugucaggcguauacccccucaguaucccagccacccuguuugugugguauuucuggcagaaaaagaagcagcggagcggcguccuuugggacacgccuucucccccagaaguugagagagcgguguuagaugacgggauuuacaggaucaugcagcguggacugcucggucgcucccaggugggcgucgggguguuccaagaaaacguuuuucacacuauguggcauguaacccggggagcuguguugauguaccagggcaaaagacuggagccgucaugggccagugucaagaaagaccucauuagcuauggugggggauggaggcugcagggcuccuggaauacaggcgaggaagugcagguuaucgcaguggagccugggaagaaccccaaaaauguccaaaccgccccaggaacauucaagacucccgaaggugaggugggcgcuauagcccuugauuuuaagccugggaccucuggaucgccaaucguaaaccgagaaggcaaaauugucggucuguacgggaauggagugguuacgacaagcggcacuuaugugucagcaaucgcucaggccaaggcgucccaggagggccccuugccugagauugaagacgaggucuuccggaaacgcaaccuaaccaucauggaucugcacccggggaguggaaagacaagaagguaccucccagccauagugcgggaagcaauuaaacgaaaguuaagaacccugauccuugcucccacucgcguuguggccucugagauggcugaagcacugaaggguaugccuaucagguaucaaaccacagccgucaaaagcgagcacacgggcaaggagauuguggaccucaugugucaugccacuuuuaccaugcguuugcuguccccaguacgggugcccaauuacaacaugaucauaauggaugaagcucacuucacagacccuucaucuauugcggcaagaggguauaucagcaccaggguuggaaugggcgaggccgcugccauuuuuaugacugcaacaccgcccgguagugucgaagccuucccacaguccaaugcugugauccaggaugaggaacgcgacauaccugagcgaagcuggaacucuggguacgaguggauuaccgauuuucccggaaaaacggugugguucgucccaucaaucaaguccggcaaugacaucgcgaacugccucaggaaaaauggcaagcggguaauucagcugaguaggaagacuuuugauacagaauaccagaaaaccaagaacaacgacugggacuaugugguuaccacugauaucagcgagaugggggccaauuuccgcgcagaccgugugauugauccuagacggugccuuaaacccgucauacuaaaggacggaccagaaagggugauccuggcugguccgaugccuguuacaguggccucggcagcccagcgccgaggcagaauugggcggaaccauaauaaagagggagaucaguacaucuauaugggccagcccuugaacaaugacgaggaucacgcucauuggaccgaagccaagauguuacuggacaacaucaauacaccagaggguauuauacccgcacucuucgaaccugagagggaaaagucugcagccaucgauggggaguaccgccugagaggcgaggcuaggaaaacuuuugucgaacuuaugcggcguggagaccugccaguguggcucuccuauaagguagccagcgagggcuuccaauacucagaucgccgaugguguuuugacggggaaagaaacaaucagguguuggaggaaaacauggauguugagauuuggacgaaagagggagaaaggaagaaacugcggccccgcuggcuagacgcuagaaccuauagugacccucuggcacucagggaguucaaggaauuugccgcuggucggcgaucugucuccggcgaucuuauccuggagauugggaaauuaccgcagcacuugacacagagagcccaaaaugcacuggacaaccucgugaugcugcacaauagcgaacagggaggccgcgcguacaggcaugccauggaggagcuuccagauacuaucgaaacccugaugcucuuggcucugauagccguguuaacagguggggucacccuauucuuucugucaggccggggacucggcaagacaaguaucgggcuucugugcguuauggcaagcuccguguugcuguggauggcuucuguagagccccacuggauugccgcaagcaucauucucgaguucuuucugauggugcuucucaucccugagcccgaccgucagagaacgccacaggauaaccaacuggccuacgucgugauaggauugcuguucaugauuuuaaccguugcugcgaaugagaugggucuacuggaaacaacuaagaaagaccucggcaucgggcauguggccgucggaaaccaccaccaugcagcuaugcuugauguagaccugcacccugccuccgccuggaccuuguaugcaguggcuacaaccauuaucacucccaugaugaagcauacaauagagaacacgaccgccaauaucucacugacugcgauugcuaaccaggccgcaauccucaugggccuggauaaagguuggccaauuucuaagauggacaucgggguuccucuuuuagcccugggcuguuacagucaggugaauccgcucacauugaccgcugcaguccugaugcuaguggcccacuaugcgauaauuggacccggccugcaagcuaaagccaccagggaagcacagaagcgcacagccgcugggaucaugaagaacccaacugucgauggaaucguggccauugaccucgauccuguuguguacgacgcaaaauuugagaagcagcuuggccagaucaugcuguugauacugugcacgucgcaaauucuccugaugcggaccacaugggcuuuaugugaaagcaucacucuugccaccgguccccugacaacccucugggagggguccccaggaaaauucuggaauacuacgauugcgguaucuauggccaacaucuuucgaggcucauaucuagcaggagcuggccuggccuucagcuugaugaagucccuaggggguggcagaagggggacaggagcacagggcgagacccucggugaaaaauggaagcgccagcuuaaucagcugaguaagucugaguucaacacuuacaaacggagcgggauaauggaaguggacagaucagaggcuaaggaaggauugaaacguggcgagaccacaaagcaugccgucuccagggguacugccaaacugcggugguuuguugagcgcaaucucgugaagccugaaggcaaggucaucgauuuagggugcggacgaggcggguggaguuauuacugugcgggacugaaaaaggugaccgagguaaaaggcuacacaaagggugggcccggacacgaagaaccgauuccaauggcuacguauggcuggaaccuugugaaacugcacagcggcaaggacguuuucuuuaucccucccgaaaaaugcgauacccuacucugugacauuggggagucuuccccaaaucccacuaucgaggaaggaagaacacugaggguguugaagauggucgagccuuggcugcgggguaaccaauucugcauuaagauccucaauccguacaugcccucaguggucgaaacccuugagcagaugcagcgcaaacauggcgggaugcuggugagaaacccauuaagcagaaauucgacucacgagauguauuggguuucuuguggaacaggcaacauaguaagugcagugaauaugaccucccgaaugcuguugaaccgguuuacgauggcccaucguaagccuaccuacgaaagagaugucgaccucggugcugggacacgccacguggccguugagcccgaaguggcaaaccuggauauuaucggacagaggaucgagaauauuaaacacgaacauaagagcacuuggcacuaugacgaggauaacccuuacaaaaccugggccuaucauggcucauacgaggucaagccauccggcucugcuagcaguauggugaaugggguagugaagcuacuuacaaaacccugggacguuauaccuauggucacucaaaucgcgaugaccgauacaaccccauucggacagcagcggguguuuaaggaaaaaguggacacuagaacgcccaaggccaaacgcgguacagcacaaauuauggaggucaccgcuaaguggcuguggggcuuccucuccaggaacaagaaaccgcgaaucugcacucgggaagaguuuaccgggaagguuagaagcaaugccgcaauuggagccguguucguagacgaaaaccaguggaacucugcuaaagaggccguggaggaugaaagguuuugggaccugguccaccgcgagcgugaauugcauaagcagggcaaaugcgcgacauguguguacaacaugauggguaagcgggagaagaaacugggggaguucggaaaggcaaaaggcucaagagccaucugguauauguggcucggcgcuagguuucuugaguucgaggcccugggguucaugaaugaagaucacugguuuagucgcgagaacuccuuaagcggaguugaaggugagggccugcacaaguugggguacauacuccgagacaucucuaaaauuccuggaggcaauauguaugcagaugacacggcugguugggauacccggaucacugaggacgaucugcagaacgaagccagaauuacagacaucauggagccagaacaugcucuacuugccaagucgauauucaaacugaccuaccaaaauaagguggucagggugcagcgccccgcaaagaacgggacuguaauggauguuauuucaagacgggaccagaggggaagcggccaggugggcacauaugggcucaauaccuuuacaaacauggaggcgcaacugauccgucagauggaauccgagggaaucuucaguccuucugaguuggaaacuccaaacuuagccgagcgaguccuggauuggcucgaaaaauacgguguggagcgccuuaagagaauggcuauuagcggcgacgacugcguggucaaacccauagaugaccgguuugccaccgcacugacggcucuaaaugauauggggaagguuaggaaagacaucccgcagugggaaccuuccaagggauggaacgauuggcagcaagugcccuucuguucacaccauuuucaccagcugauuaugaaggacggccgcgagaucguagugccaugcagaaaucaggaugagcucgucggucgggccagggugagucagggggcaggauggucuuugcgagaaaccgccugucugggcaaaagcuaugcgcaaauguggcagcuuauguacuuccaccguagagaccugcgccucgcugccaacgcaauuugcuccgccguuccuguggauuggauccccacaucacggacuaccuggagcauacaugcucaccaucaguggaugacaacugaggacauguuaucugucuggaauaggguguggaucgaagagaacccauggauggaagauaagacccacauuuccaguuggggcgacguacccuaccuggggaaaagagaggaccaaugguguggcagcuugaucggucugacggcccgcgcaacaugggcuaccaauauucagguugccaucaaccaggugcggaggcucauuggcaaugagaacuaucuugauuacaugacuucgaugaagcgauuuaaaaaugaauccgacccuaagggggcgcugugguga

SEQ ID NO: 13323 - RNA, 9879 nt, Artificial Sequence
  derived and/or modified CDS sequence (opt3) from DENV-1__GU131956__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcacgaucuucauauuacugaugcuugugacuccaucaauggccaugcggugcgucgggaucggaaaccgcgauuuuguggaggguuugagcggcgcgacauggguagacguugugcuggagcacgggaguugugucaccacuauggcaaagaauaaacccacacuagauauugaacuccugaagaccgaggugacgaacccugccauccuuagaaaacugugcauugaagcuaagaucuccaauaccacaacugacucuagguguccaacccagggagaggccacauugguggaagagcaggaugcaaacuucgucugccggcgcacuuuuguugaccgaggcugggguaauggguguggacucuucggcaaaggcagccuguuaaccugcgcuaaguuuaagugcgugacaaaacuggaggggaagauaguacaguacgaaaaccucaaauauuccgugauugucaccgugcacacuggagaucaacaucagguugguaaugagacgacagaacacggcaccaucgccacuauuaccccccaggcgccuacaucagagauccagcuuaccgacuacggggcccugacuuuggacuguaguccaagaacaggacuagauuucaacgaaauggugcugcucacgaugaaggagaaaagcuggcugguccauaagcaaugguuucuugaccugccguugcccuggaccucuggcgcauccacuucacaggagacauggaauaggcaggaucuccuggugaccuucaaaacagcucacgccaagaagcaagaaguaguuguguuagguagccaggagggggcuaugcacacugcccugaccggcgcaacggaaauccagaccaguggaacaacuaccauuuuugccggccaucuaaaaugccggcucaagauggacaaacugacacuuaaggggacuucuuaugucauguguaccggauccuucaaauuggagaaggaaguggcugagacgcagcacgguacaguccuggugcaaguuaaguacgagggcaccgaugcgccuugcaaaauaccauucagcacucaggacgaaaagggggugacacagaacggacgucucaucaccgcaaaucccauuguaacugauaaagagaagccugucaacaucgaaaccgagccacccuuuggcgagucguauauagugguuggugccggggaaaaagcucugaagcuuucuugguucaagaaaggcuccucaauuggaaagauguuugaggccacagcacgcggcgccagaaggauggcuauccugggggacacggccugggauuucggaaguaucgguggcguguuuaccagcgucgggaaauuggugcaucagguauucggaacugcauacggcgugcucuuuuccgguguuucuuggacaaugaagauugggaucggcauucuguuaaccuggcugggacuaaauagccggucaacaagucucuccaugacuuguauagcggucggcauggugacccuguaccuuggggugaugguccaagcugacagcggaugcguuaucaacuggaaaggccgagaauugaagugugguucugggauuuucgugacgaacgaggugcacacauggaccgaacaguauaaguuucaggccgauucaccgaaacgccugagugcagccaucggaaaggcuugggaggagggcguaugcgguaucagaagcgccacuaggcucgaaaauauuauguggaaacagauauccaacgagcugaaucauaucuuacuggaaaacgacaugaaguucaccgucgugguuggcgacgcaaaugggauucuugcucaaggaaaaaagaugauccggccucagcccauggagcacaaauacucuuggaagucguggggcaaggccaaaauuaucggggcggauauacagaacacaacuuuuaucauugacggaccagauaccccugaaugucccgacaaucagcgcgccuggaacaucugggagguggaggauuauggcuucgguauuuuuacaacgaauaucugguugaagcucagagacagcuacacccaaaugugcgaucacaggcugauguccgcugcaauaaaagacucaaaggccguccaugcugauaugggguauuggauugaaagugagaaaaacgaaacuuggaagcuagcccgugcaucuuucaucgaggugaagacauguaccuggccaaaaagccacacucugugguccaauggaguucucgaaucagagaugauuauccccaagauauacggcgguccuaucagccagcauaacuaucggccaggcuacuucacacagaccgcggggccguggcaccugggaaaacuugaguuggacuuugaucugugcgaaggcacgacugugguagucgacgagcacugcgggaaucgaggacccucuuuaagaaccacaaccgugacuggcaagauuauccaugaaugguguugcagguccuguacacucccuccacugcgcuuccggggugaggaugggugcugguacggaauggagauuagacccgugaaagaaaaggaggaaaaccuugucaggaguaugguuagcgccggcucuggugagguggacuccuuuucacugggcaucuugugugcuaguauaaugauugaagagguaaugcgcagccgauggucgcggaagaugcucaugaccgggacacuggccguguuccuacugcucgucaugggacaacugacuuggaaugaccuuauccguuugugcaucauggugggcgcaaacgcuuccgauagaauggggaugggaaccacguaucuggccuuaauggcaacauuuaaaaugaggccuauguucgccguuggccuccuguuucgccggcuuaccucuagagaggugcugcuacucacuauuggucugagcuuggucgcuucaguggaacugccaaacaguuuagaggaacucggggacggacuggcgaugggcaucaugaugcuuaagcuguugaccgaguuccagccccaccagcucuggacaacucugcuaucccugaccuuuauuaaaacgacacuuucucucgauuacgccuggaagaccacugcaauggcucugagcauaguuuccuuguucccgcuguguuuaucaacaaccagccagaaaacuacauggcucccugugcugcuuggcaguuuugggugcaagccacugaccauguucuugaucacggaaaauaagauuuggggaaggaaaucuuggccccucaacgaggguaucauggccauuggcaucgucuccauacugcuaagcucgcugcuuaagaaugacguaccucucgccgggccccugaucgcuggaggcauguugauugcauguuaugugaucucagguucuagugccgauuuaucccuggagaaagcggcugaaguuagcugggagcaagaagccgagcauucugggacuagccacaacauucucguggaaguccaggacgauggaaccaugaagaucaaagacgaggagcgagaugacacacugaccauacuucugaaggcaacauugcuagccguguccggcguauacccaaugucaauuccugcuacucuguuugugugguauuucuggcagaaaaagaagcagcgcaguggcguccucugggauacccccagcccaccggaaguugagcgggcagugcuggacgaugggaucuacagaauccuucaaaggggauuacugggucguucucaggugggcgucgggguguuccaggacggaguuuuucauacgauguggcacguaacacgcggcgccgugcucauguaucaggguaaacgguuggaaccuuccugggcgucagucaagaaagaccugauuaguuacgggggaggcuggagauuccaaggcagcuggaauacuggggaggaggugcagguuauagcuguggaacccggaaagaacccaaaaaauguccagaccacacccgguaccuuuaagacuccugagggcgaagugggggccaucgcacucgauuucaagccaggaaccuccggcucucccauuguaaacagggaggguaaaaucgucgggcuguacggaaauggcgugguuacaacgucgggcacuuaugugagcgccauugcucaagccaaggcaucacaggaagggccucuuccggagaucgaggacgaagucuuuaaaaagcgaaaccugaccauaauggauuugcacccaggauccgguaaaacacggcgcuaccuacccgcuauggugagagaggccaucaagaggaagcugcggacccucauuuuagcgccuacucgaguuguggccagugaaauggcagaggcucugaaaggcaugccaaucagauaucagacaaccgccgucaagucugaacauacggggcgcgagauuguggaccuuaugugccacgcuacuuucacaaugaggcugcucagccccguacgugugccuaauuacaacaugaucauaauggaugaggcacauuuuaccgacccggccuccauugccgcucggggauauaucucaaccagaguuggcaugggugaagcggcagccaucuucaugacugcuacacccccagggucugucgaggccuuuccucagagcaaugcagugauucaagaugaagagagggacauccccgaacgcaguuggaacuccggauacgauuggauaaccgacuucccaggcaaaacagugugguuugucccuagcauuaagucuggcaaugauaucgccaacuguuugcgaaaaaacgggaagagaguaauucagcugucacggaagacuuucgacacggaguaucagaaaaccaagaauaacgacugggauuacgugguuacaacugacaucuccgagaugggagcuaauuucagggcggaucgcgugauagacccccguagaugccucaaaccagucauucugaaggaugguccggaacgggugauccuugccggcccuaugcccguuaccguggcaagugcugcccagaggcgcgggcgaaucggaagaaaccaaaauaaagagggcgaccaguacgucuauaugggucagccacuaaacaaugaugaagaccacgcacauuggacagaggccaagaugcuguuggauaacauuaauacccccgaggggaucauuccugcuuuauuugaaccagagcgggaaaagagcgccgcgauagacggcgaguacaggcugcgcggagaagcaagaaaaacuuucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagaucuggacgaaagaaggugagagaaagaaacucaggccucggugguuggacgcucgcaccuauagcgauccgcuggcccuaagagaguuuaaggaauucgcugcaggcaggcggucagugaguggggaccugauucucgagaucggaaaacuuccacagcaccugacauuacgagcccagaaugcuuuggauaaccuggugaugcuccacaauucugaacagggcgguaaggccuacagacaugcaauggaggaacugcccgacacuaucgagacccuuaugcugcucgcguugauugccguccugacagggggcguuaccuuauuuuuccuauccggaaagggccuggggaaaacuagcauaggacuccuuugugugacagcuucaagugcccuguuguggauggcaagcguagagccucacuggaucgcugccuccauuauccuggaauuuuuccucauggugcugcuuauucccgagccagaucgccaaaggacgccucaggacaaccagcucgcauaugucgugaucggucuguuguuuaugauacugaccguugccgcuaacgaaaugggcuuacuagagacuacaaagaaagaucuggggaucggacauguggcggccgagaaucaccaacacgcaaccaugcucgacgucgaucuucggcccgcuucugccuggacccuguacgccguagcaacaacugugauuacgccaaugaugcgucauaccaucgaaaacacaacugcuaauauuagcuugaccgccaucgcgaaccaggcugccauacugaugggccucgacaaggguuggccuauuuccaaaauggauaucgggguuccgcugcuugcauuaggcugcuacucacaggugaauccccugacacucaccgccgcugucuugaugcugguggcacacuaugccauuaucggaccaggccuacaggcgaaggcuacuagagaggcccaaaagaggacggcagccgggauaaugaaaaacccuacagucgacggaaucguggcuauugaucuggaccccguuguguacgacgccaaguucgaaaaacagcucggccagaucaugcuucugauuuuguguaccucucagauccugcucaugcgcacuaccugggcacugugcgagaguauaacauuagcuacugguccacuuaccacacugugggaagggucgccuggaaaguuuuggaauacgaccauugccguaagcauggcgaacaucuuccggggcuccuaucucgccggugcaggccuagcuuucucucugaugaaaucauuggggggaggccgaagagggacuggagcccaaggcgagacacugggugagaaguggaagaggcagcucaaucagcuuagcaaauccgaauuuaacaccuacaagcgcagugggaucauggagguggaucggucugaagcaaaagagggacugaagagaggcgaaacuacaaaacaugcugucagccgugguaccgccaaguugaggugguucguugagcggaaucuggugaagcccgagggcaaagucauugaccucggguguggacgcggcggguggucauauuacugcgccggauuaaagaaagugacggaaguaaagggcuauaccaaaggugggccgggacacgaggaaccaaucccuauggcgacauacggcuggaaccuggugaagcuucauuccggcaaagauguuuuuuucaugcccccagagaagugugacacucugcuaugcgauauaggggaaaguagccccaauccuaccauugaggagggacgaacacucagagugcugaagauggucgaaccgugguugagggguaaccaguuuuguaucaaaauucugaaucccuacaugccaucuguggucgagacucucgaacaaaugcagcggaagcacggcgggaugcuugugcgcaacccucuguccagaaauucaacccacgagauguauuggguuagcugcggaacaggcaacaucguaucggcugugaacaugaccucuaggauguuacugaaucgauucacuauggcacaucggaaacccacguacgagcgugacgucgauuugggugccgggacaagacacguggcuguugaaccugagguggccaaccucgacauaaucggacagcgcauugaaaauaucaagaacgagcauaaaaguaccuggcacuaugaugaagacaauccauacaagacuugggcauaucacggcuccuacgaggucaagcccagcggcucagccuccucuauggugaacgggguagugaggcugcuaaccaaaccuugggauguuauuccaauggucacacaaaucgcuaugacggacaccacucccuuuggacagcagcggguguucaaggagaaaguggacacaagaaccccgcgcgcgaagagggguacuacacagauuauggaagucaccgccaaauggcuuuggggcuuucugagccgaaauaagaagccucggaucuguacaagagaggaauucacuaggaaaguucgcaguaacgcagcuauaggggccguguuuguagaugagaaucaauggaacuccgcaaaggaagccguggaggacgagcguuucugggaucucguccaucgggaaagagagcugcacaaacagggaaagugcgcuaccugcguguauaauaugaugggcaaaagggaaaagaaguugggugaguuugggaaagccaagggaagccgcgcgauuugguacauguggcugggcgcacgauuccucgaauucgaggcccuuggcuuuaugaacgaggaccauugguucucucgggaaaauucacugagugggguugagggagaagguuuacacaaacugggcuacaucuugagagauaucuccaagauuccagggggaaacauguaugcugacgauacggccggcugggacaccaggauaacagaggaugaccuccagaaugaggcaaaaaucacugaaauuauggagcccgaacaugcucugcuagccaccagcaucuuuaagcuuacauaccagaacaaagugguccgcgugcaaagaccugcuaagaacgguacuguaauggauguuauuucucggagggaccagcgugggucgggacaggugggcaccuauggccugaauacguucacaaacauggagguccagcucauccgacaaauggaaucagaggggauauuucugccaagcgaguuggaaacccccaauuuagccgagcgcgugcuggauuggcucgaaaagcacggagcagagagacuuaaacggauggcgaucuccggugacgacuguguggucaagccgauugaugacagguucgccacugcucugacagcccuaaacgauaugggcaaaguucgcaaggacaucccucagugggaacccaguaaaggguggaaugauuggcagcaggugccauuuugcucucaccauuuccaccaacugauuaugaaggacggaagagagaucguagugccuugucggaaccaggaugagcucgucggcagggcacgagugagccagggugcugggugguccuugcgugaaaccgccugccugggaaagucauacgcacaaauguggcagcuuauguauuuucauagacgcgaccugcggcucgccgcgaaugcuauauguagugccguucccguggauugggucccaacuucuaggaccacauggagcauucacgcacaccaucaguggaugacgaccgaggacauguuauccguguggaacagaguauggaucgaagagaaucccuggauggaagauaaaacucacguuucaagcugggaggaggugccuuaccugggcaagcgcgaagaccaguggugcggcucuuugaucgggcugacagcccgggcuaccugggccacuaacauucaagucgcaauaaaucaggugaggcgacucaucggaaacgagaauuaucuugacuacaugacauccaugaaaagauucaagaacgaaagugauccagagggugcucugugguga

SEQ ID NO: 13324 - RNA, 9879 nt, Artificial Sequence
  derived and/or modified CDS sequence (opt3) from DENV-1__GU131958__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauaauggagguagaucggucugaagcaaaagagggacugaagagaggcgaaaccacuaaacaugcugugagccgugguacagccaaguugaggugguucgucgagcggaaucugguuaagcccgagggcaaagugauugaccucggguguggacgcggcggguggucauauuacugcgccggauuaaagaaagucaccgaagugaagggcuauacgaaaggugggccgggacacgaggaaccaaucccuauggcgaccuacggcuggaaccugguaaagcuucauuccggcaaagauguguuuuucaugcccccagagaagugugacacacugcuaugcgauauuggggaaaguagccccaauccuacuaucgaggagggacgaacccucagaguucugaagaugguggaaccgugguugagggguaaccaguuuuguauaaaaauccugaaucccuacaugccaucugucguggagacacucgaacaaaugcagcggaagcacggcgggaugcuuguccgcaacccucuguccagaaauucaacucacgagauguauugggugagcugcggaaccggcaacauuguuucggcuguaaacaugacaucuaggauguuacugaaucgauucaccauggcacaucggaaacccacuuuugagcgugacguggauuugggugccgggacgagacacgucgcuguggaaccugagguugccaaccucgacaucauuggacagcgcaucgaaaauauuaagaacgagcauaaaaguacauggcacuacgaugaagacaauccauauaagaccugggcauaccacggcuccuaugaggugaagcccagcggcucagccuccucuauggucaacggggugguaaggcugcuaacuaaaccuugggaugugaucccaaugguuacccaaauagcuaugacagacacgacccccuucggacagcagcgggucuuuaaggagaaaguggacacuagaacaccgcgcgcgaagagggguaccacucagauuauggaagugacagccaaauggcuuuggggcuuccugagccgaaauaagaagccucggaucuguaccagagaggaauuuacaaggaaaguccgcaguaacgcagcuaucggggccguuuucguggaugagaaucaauggaacuccgcaaaggaagccguagaggacgagcguuuuugggaucucgugcaucgggaaagagagcugcacaaacagggaaagugcgcuacuugcgucuacaauaugaugggcaaaagggaaaagaaguugggugaguucgggaaagccaagggaagccgcgcgauuugguauauguggcugggcgcacgauuccucgaauuugaggcccuuggcuucaugaacgaggaccauugguuuucucgggaaaauucacugagugggguggagggagaagguuuacacaaacugggcuacauauugagagauaucuccaagauuccagggggaaacauguacgcugacgauaccgccggcugggacacgaggaucaccgaggaugaccuccagaaugaggcaaaaauuacagauaucauggaacccgagcaugcucugcuagccacuagcauauucaagcuuaccuaucagaacaaaguugugcgcguccaaagaccugcuaagaacgguacagugauggacguaaucucucggagggaucagcgugggucgggacagguuggcacuuacggccugaauaccuuuacgaacauggaagugcagcucauucgacaaauggagucagaagggaucuuccugccaagcgaguuggagacacccaauuuagccgaacgcguccuggacuggcucgagaagcacggagcagaaagacuuaaacggauggcgauuuccggugacgauuguguggugaagccgaucgacgauagguuugccaccgcucugacugcccuaaacgacaugggcaaaguccgcaaggauauaccucagugggagcccaguaaaggguggaaugacuggcagcagguuccauucugcucucaccauuuucaccaacugauuaugaaggauggaagagaaaucgugguaccuugucggaaccaggacgagcucgugggcagggcacgagucagccagggugcugggugguccuugcgugagacagccugccugggaaagucauaugcacaaauguggcagcuuauguacuuccauagacgcgaucugcggcucgccgcgaaugcuaucuguagugccgugcccguugacugggugccaaccucuaggacuaccuggagcauucacgcacaccaucaguggaugacaacggaagauauguuauccgucuggaacagaguguggauagaggaaaaucccuggauggaggacaaaacccacguaucaagcugggaagagguuccuuaucugggcaagcgcgaggaccaguggugcggcucuuugaucgggcugacugcccgggcuacaugggccaccaacauucaaguggcaaucaaucaggucaggcgacucauuggaaacgaaaauuaccuugauuauaugacuuccaugaaaagauuuaagaacgagagugacccagaaggugcucugugguga

SEQ ID NO: 13325 - RNA, 9879 nt, Artificial Sequence
  derived and/or modified CDS sequence (opt3) from DENV-1__GQ868499__SS-prME
agcgugaccaugcugcucaugcuucugcccacagcauuggcuuuccacuuaacuacgcggggaggggaaccucauaugaucgucuccaagcaggaaaggggaaaaucucugcuauuuaagaccucagccgguguuaauaugugcacacucauugccauggaccugggagaacuuugugaagauacuaugaccuacaaaugcccacaaauaacagaggcggaaccggacgauguggacuguuggugcaaugcuaccgauacuuggguaacauaugggaccuguagucagacgggaggccaccggcgcgagaagcgaagcguggcccuggcaccccaugucgguuuggggcucgagacucguaccgaaacauggauguccucugagggagccuggaaacagauccagagaguggaaacuugggcucugaggcacccuggcuucaccguuauugcacuguuucucgcccaugcuaucggcacaucgauuacccaaaaggggaucauuuucaucuuacugaugcuugugacgccaucaauggccaugcggugcgucggaauugguaaucgcgacuuuguggagggcuugagcggggcgacuuggguugauguugugcuggagcacggaaguugugucacaaccauggcaaagaauaaacccacucuagacaucgaacuccugaagacagaggugaccaacccugccgugcuuagaaaacugugcauugaagcuaagaucuccaauacgaccacagauucuagguguccaacucagggcgaggccaccuuggucgaagaacaggacgcaaacuucguuugccggcgcacauuuguggaucgagguugggggaauggauguggccucuucggcaaagggagccuguuaacuugcgcuaaguuuaagugcguaaccaaacuggagggaaagauagugcaguacgaaaaccucaaauauuccgucauugugacaguucacaccggugaccaacaucaggugggcaaugagacuacggaacacgggacaaucgccaccauuacuccccaggcgccuaccucagagauccagcuuacagauuacggagcccugaccuuggacuguaguccaagaacuggccuagacuucaacgaaaugguccugcucacaaugaaggagaaaagcuggcuggugcauaagcaaugguuucuugaucugccguugcccuggacgucuggugcauccaccucacaggagacuuggaauaggcaggaccuccugguaacauucaaaaccgcucacgccaagaagcaagaaguuguggucuuagggagccaggagggcgcuaugcacacagcccugacuggagcaaccgaaauccagacgaguggcaccacaacuauuuuugccgggcaucuaaaaugccggcucaagauggauaaacugacccuuaagggaacaucuuaugugauguguacugguuccuucaaauuggagaaggaagucgcugagacccagcacggcacggugcugguucaagugaaguacgaggggacagacgcgccuugcaaaauaccauucagcacccaggaugaaaagggaguaacucagaacggccgucucaucacagcaaaucccauugucaccgacaaagagaagccugugaacaucgaaacugagccacccuuuggugagucguauauaguugugggggccggcgaaaaagcucugaaacuuucuugguucaagaaaggauccucaauuggcaagauguuugaggccaccgcacgcggggccagaaggauggcuauccugggagauacagccugggacuucgguaguaucggcggggucuuuacgagcgugggaaaauugguacaucagguguucggcaccgcauacgguguucucuuuuccggggucucuuggacuaugaagauuggcaucggcauucuguuaacauggcugggccuaaauagccggucaaccagucucuccaugacauguauagcgguggggauggugacucuguaccuuggagucaugguucaagcugauagcggcugcgugaucaacuggaaaggucgagaauugaagugugggucuggaauuuucgugaccaacgagguacacacguggacagaacaguauaaguuucaggccgacucaccgaaacgccugagugcagccaucggcaaggcuugggaggagggugucugcggcaucagaagcgccaccaggcucgaaaauauuauguggaaacagauauccaacgagcugaaucauaucuuacuggaaaacgauaugaaguucacugugguugugggggacgcaaauggcauucuugcucaaggcaaaaagaugauccggccucagcccauggagcacaaauacucuuggaagucgugggggaaggccaaaauuaucggagcggacauacagaacaccacauuuaucauugauggcccagacacuccugaaugucccgauaaucagcgcgccuggaacaucugggaggucgaggacuaugguuucgggauuuuuaccacaaauaucugguugaagcucagagauagcuacacgcaaaugugcgaccacaggcugauguccgcugcaauaaaagauucaaaggccgugcaugcugacaugggauauuggauugaaagugagaaaaacgaaaccuggaagcuagcccgugcaucuuucaucgagguuaagacuuguacauggccaaaaagccacacccugugguccaauggcgugcucgaaucagagaugauuauccccaagauauacgguggcccuaucagccagcauaacuaucggccaggguacuucacucagacagcgggaccguggcaccugggcaaacuugaguuggauuuugaccugugcgaagggaccacgguagucguggaugagcacugcggaaaucgaggccccucuuuaagaacuaccacagugaccgguaagauuauccaugaaugguguugcagguccuguacucucccuccacugcgcuucagaggggaagacggaugcugguacggcauggagauuagacccgucaaagaaaaggaggaaaaccuuguuaggaguauggugagcgccgguucuggcgagguagauuccuuuucacuggggaucuugugugcuaguauaaugauugaagaggugaugcgcagccgauggucgcggaagaugcucaugacaggaacccuggccgucuuccuacugcucaucaugggccaacugacauggaaagaccuuauccguuugugcauuauggugggggcaaaugcuuccgacagaaugggaaugggcacuaccuaucuggccuuaauggcaacguuuaagaugaggccuauguucgccguuggucuccuguuucgccggcuuacaucuagagaggugcugcuacucaccaucgggcugagcuuggucgcuucacuggaauuaccaaacagucucgaggaacugggagauggccuugcgaugggcauuaugaugcugaaauugcucacugaguuccagccccaccagcuguggaccacacuacugucccuuacuuuuauaaagaccacgcucucucuggacuacgccuggaaaacaaccgcaauggcuuugagcaucgugucccuguucccguuaugucucucaacuacaagccagaagaccacuuggcugccuguucuucuggggaguuuuggaugcaagccauugacaauguuccucauuaccgaaaacaaaaucugggguaggaagucuuggccccugaaugagggcauuauggccaucgggauaguguccauccuacugagcucgcuucucaaaaacgaugucccucuggccggacccuugauugcuggcgguauguuaaucgcauguuauguaauuucagggucuagugccgaccugucccucgagaagguggcggaaguuagcugggagcaagaagcugagcauucuggaacgagccacaauauccugguggaaguccaggaugacggcacuaugaaaauaaaggaugaggagcgagacgauacccuuacaauucuguugaaagccacccuacuggcaguguccggcguauacccaaugucaaucccugccacacucuuugugugguauuucuggcagaagaagaaacagcgcagugggguccugugggacacucccagcccaccggaaguugagcgggcugugcuugaugacggaaucuacagaauuuuacaaaggggucugcucggccguucucaggugggggucggaguguuccaggauggcguuuuucauaccauguggcacguaacgcgcggugcaguguugauguaucaggggaagcggcuggaaccuuccugggccucagucaaaaaggaccucauaaguuacggaggcggcuggagauuccaagggagcuggaacacaggagaggaggugcagguuaucgcgguggaacccgguaaaaauccaaagaacguccagacuacccccggcacauuuaagaccccugagggggaagugggagcuauugcccuggacuucaaaccaggcacuuccgguucucccaucguaaauagggaggggaagauugucggacuuuacggcaacggcgugguuaccacaucggggacguaugugagcgcaaucgcccaagcuaaagccucacaggaaggaccucugccggagauagaggaugaagucuuuaagaaacgaaauuugacuaucauggaccuacacccagguuccggcaagacccggcgcuaccugcccgcaauugugagagaggcuaucaagaggaaacuccggacauuaauucuggccccuacccgaguuguggcgagugaaauggccgaggcacuuaaggggaugccaaucagauaucagacuacagcugucaaaucugaacauaccggacgcgagauaguggaucugaugugccacgccacguucacuaugaggcucuugagccccguacgugugccuaacuacaauaugauuaucauggacgaggcucauuuuacagauccggcauccaucgccgcccggggcuauauuucaaccagaguugguaugggggaagcugcggcaaucuucaugaccgccacucccccaggaucugucgaggcuuuuccucagagcaacgccgugauacaagacgaagagagggauauucccgaacgcaguuggaacuccggcuacgacuggaucacagauuucccaggcaagaccgugugguuugucccuagcauuaaaucugggaacgacaucgcaaauugucugcgaaagaacggaaagagaguaauacagcucucacggaaaacauucgauacugaguaucagaagacgaaaaacaaugacugggacuacgugguuaccacagauauuuccgagaugggugccaacuucagggcugaccgcgugaucgauccccguagaugccugaagccagucauccuuaaagacggcccggaacgggugauucuagcggggccuaugcccguuacuguggccagugcagcucagaggcgcggacgaaucggcagaaaucaaaacaaggagggugaucaguacgucuauauggggcagccacugaauaacgacgaagaucacgcccauuggaccgaggcaaagauguuguuagacaauauuaacacacccgagggcauaaucccugcccuguuugaaccagagcgggaaaagagcgcugccauugauggagaguacaggcuccgcggcgaggcgagaaagaccuucguggagcugaugaggcguggggaccuucccguauggcugucguauaaaguggcaucugagggauuucaguacuccgaucggcgcuggugcuucgacggugaacgaaauaaccaaguucucgaggaaaauauggaugucgagaucuggacuaaggaaggcgagaggaagaaguugaggccucgguggcuggacgcccgcacguauagcgacccgcuagcucugagagaguuuaaagaguucgccgcugggaggcggucagugaguggagaucucauccuugagauuggcaagcugccacagcacuuaaccuugcgagcacagaacgcccuggacaaucucgugaugcugcacaacucugaacagggugggaaggcuuacagacaugccauggaggaacuucccgauacaauagagacucugaugcucuuggcacugaucgcggucuuaaccggcggaguuacacuauuuuuccuguccggcaaagggcucggaaagaccagcauuggucuucugugugugacugccucaagugcuuugcuguggauggccagcguagagccucacuggaucgcagcuuccauuauccucgaauuuuuccugauggugcuucucauacccgagccagaccgccaaaggacaccucaggauaaucagcuggccuaugucgugaucggcuugcuguuuaugauuuuaacgguugcagccaacgaaauggggcuacuggagaccacuaaaaaggaccucggaaucggccauguggcugcggagaaccaccaacacgccacaaugcuugaugucgaccugcggcccgcaucugcuuggaccuuguacgccguagccaccacagugauuacuccaaugaugcgucauacgaucgaaaauaccacagcaaacauaagccugacugcuauugccaaucaggcggcuauccucaugggucuggauaaaggguggccuauuuccaagauggacaucggcguuccgcuuuuagcccugggaugcuacucacaggugaacccccucaccuugacagcagccguccugaugcuaguggcucacuaugcaauaaucggcccagggcugcaggccaaggcgaccagagaggcucagaaaagaacugccgcaggaauuaugaagaauccuacggucgauggcaucguggccauugaccucgaucccguuguguacgacgcuaaauucgaaaagcagcuuggucagaucaugcuguugauacuguguacaucucagauucuccugaugcgcaccacuugggccuuaugcgagaguaucacccuugcaacagggccacugacuacccucugggaaggaucgccuggcaaauuuuggaacacaacgaucgcuguaagcauggccaauauuuuccgggguuccuaucuagcgggcgccgggcuggcauucucuuugaugaagucacugggaggcgggcgaagaggaaccggcgcucaaggugagacucucggggagaaguggaaaaggcagcuuaaccagcugagcaaguccgaauuuaauacauacaaacgcaguggaaucauggagguggaccggucugaagccaaggagggcuugaaaagaggugaaaccacuaagcaugcagucagccguggcacagcuaagcugaggugguucguugagcggaaccucgugaaacccgaggggaaggucauagauuuaggauguggccgcgggggauggucauauuacugcgccggccugaaaaaggugaccgaaguaaaagguuauacgaaagggggaccgggccacgaggaaccaauuccuauggccaccuacggcuggaaucuugugaaacugcauuccgggaaggacguauuuuucaugcccccagagaagugugauacacuacucugcgacaucggagaaaguagccccaacccuacuauugaggagggucgaacccugagaguguugaaaauggucgaaccguggcugaggggcaaucaguuuuguaucaagauacucaaccccuacaugccaucuguggucgagacacuugaacaaaugcagcggaaacacgggggaaugcuggugcgcaauccuuuauccagaaacucaacucacgagauguauuggguuagcugcggcaccgguaauaucguaucggcggugaacaugacaucuaggaugcuguugaaccgauucaccauggcucaucggaagcccacuuacgagcgugaugucgaccucggggcaggaacgagacacguggccguugaaccugagguggcuaaucuggauauuaucggccagcgcauugaaaacaucaaaaaugagcauaagaguacauggcacuaugacgaagauaacccauacaagaccugggccuaucacggcuccuacgaggucaaacccagcgggucagcauccucuauggugaauggaguagugaggcuacuuacuaagccuugggacguuauuccaauggucacccaaaucgccaugacagauacgacccccuuuggucagcagcggguguucaaagagaagguggacacuagaacaccgcgcgcuaaaaggggcaccacucagauaauggaagucacagcgaaguggcuguggggguuucucagccgaaacaagaaaccucggauuuguaccagagaggaguucacaaggaagguucgcaguaaugccgcaaucggagcuguguuuguagacgagaaccaauggaacuccgccaaagaagcaguggaggaugagcguuucugggaccugguccaucgggaaagagaguugcacaagcagggcaaaugcgccacuugcguguauaacaugauggguaagagggaaaagaaacugggggaguuuggaaaggcuaaaggcagccgcgccaucugguacauguggcucggcgcgcgauuccuugaguucgaggcacugggguuuaugaaugaggaucauugguucucucgggaaaacucauuaaguggaguugagggugaaggccugcacaaguugggguacauucucagagacauauccaaaaucccaggaggcaauauguaugccgaugacaccgcugguugggauacgaggauuaccgaggacgaucugcagaacgaggccaagaucacagacauuauggaacccgagcaugcacuacuugcuacuagcaucuuuaaacugaccuaccagaauaaggugguccgcgugcaaagaccugccaagaacgggacaguaauggauguuauaucucggagggaccagcguggaucgggccaggugggcacuuaugggcucaacaccuucacgaauauggaaguccagcugauccgacaaauggagucagaaggaauauuuuugccaagcgaguuagagacacccaaccuggcugaacgcgugcucgauuggcuugagaaacacggugccgaaagacugaagcggauggcaaucuccggcgacgacuguguggucaaaccgauugaugacagguucgcgaccgcccuaacugcucugaaugauauggggaagguucgcaaagacaucccucagugggagcccaguaagggauggaacgauuggcaacaggugccauuuugcucucaccauuuccaccaacucauaaugaaggacggcagagaaauuguagugccuugucggaaucaggaugaguuggucgguagggcccgagugagccagggggcaggauggucccugcgugagacagcuugccuuggcaaaucauacgcccaaauguggcagcugauguauuuucauagacgcgaccuccgguuagcagccaacgcgaucuguagugcuguucccguggauugggucccaaccucuaggacuaccuggagcauccacgcccaccaucaguggaugacaacggaagacaugcuguccguguggaauagaguauggauugaggaaaaccccuggauggaggauaagacccacguuucaagcugggaagaggugccuuacuugggcaaacgcgaggaccaguggugcgggucucugauaggacucacugcacgggccacaugggcuaccaauauccaagucgccauuaaccaggugaggcgacuuaucgguaaugaaaacuaucuggacuacaugacuuccaugaagagauucaaaaaugagagugauccagaaggcgcacuaugguga

SEQ ID NO: 13326 - RNA, 9879 nt, Artificial Sequence
  derived and/or modified CDS sequence (opt3) from DENV-1__GQ868500__SS-prME
agcgugaccaugcugcucaugcuucugccaacagcauuggcuuuccacuuaacuacgagaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggaccacacugcuaucccugacuuuuauaaaaaccacgcuuucucucgauuacgccuggaagacaaccgcaauggcucugagcaucguuuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauuauggccaucggcauagucuccauccugcuaagcucgcugcuuaagaaugacguaccucucgccgggccccugauugcuggaggcauguugaucgcauguuaugugauuucagguucuagugccgauuuaucccuggagaaagcggcugaaguuagcugggagcaagaagccgagcauucugggacgagccacaacauccucguggaaguccaggacgauggaacuaugaagauaaaagacgaggagcgagaugacacccugacaauucuucugaaggcaaccuugcuagccguguccggcguauacccaaugucaaucccugcuacacuguuugugugguauuucuggcagaaaaagaagcagcgcaguggcguccucugggauacucccagcccaccggaaguugagcgggcagugcuggacgaugggaucuacaggauucuucaacgaggauuacugggucguucucaggugggcgucgggguguuccaggacggaguuuuucauaccauguggcacguaacgcgcggcgccgugcucauguaucaggguaaacgguuggaaccuuccugggcgucagucaagaaagaccugauaaguuacgggggaggcuggagauuccaaggcagcuggaauacaggggaggaggugcagguuaucgcuguggaacccggaaagaaccccaagaauguccagacuacccccgguacauuuaagaccccugagggcgaagugggggccauugcacucgauuucaagccaggaacuuccggcucucccaucguaaacagggaggguaaaauugucgggcuguacggaaauggcgugguuaccacaucgggcacguaugugagcgccaucgcucaagccaaggcaucacaggaagggccucuuccggagauagaggacgaagucuuuaaaaagcgaaaccugacuaucauggauuugcacccaggauccgguaaaacccggcgcuaccuacccgcuauggugagagaggccauuaagaggaagcugcggacacucaucuuagcgccuacccgaguuguggccagugaaauggcagaggcucugaaaggcaugccaauuagauaucagacuacagccgucaagucugaacauaccgggcgcgagaucguggaccuuaugugccacgcuacguucacuaugaggcugcucagccccguacgugugccuaauuacaacaugauaauuauggaugaggcacauuuuacagacccggccuccaucgccgcucggggauauaucucaaccagaguuggcaugggugaagcggcagccauuuucaugaccgcuacucccccagggucugucgaggccuuuccucagagcaaugcagugauccaagaugaagagagggacauacccgaacgcaguuggaacuccggauacgauuggauuacagacuucccaggcaaaaccgugugguuugucccuagcaucaagucuggcaaugauauugccaacuguuugagaaagaacgggaaaagaguaauccagcugucacggaagacauucgacacugaguaucagaaaacgaagaauaacgacugggauuacgugguuaccacagacauauccgagaugggagcuaauuucagggcggaucgcgugauugacccccguagaugccucaaaccagucauccugaaggaugguccggaacgggugauccuugccggcccuaugcccguuacuguggcaagugcugcccagaggcgcgggcgaauuggaagaaaccaaaauaaagagggcgaccaguacgucuauaugggucagccacuaaacaaugaugaagaccacgcacauuggaccgaggccaagaugcuguuggauaacaucaauacacccgaggggauuauaccugcuuuauuugaaccagagcgggaaaagagcgccgcgaucgacggcgaguacaggcugcgcggagaagcaagaaaaaccuucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagauuuggacuaaagaaggugagagaaagaaacucaggccucggugguuggacgcucgcacguauagcgauccgcuggcccuaagagaguuuaaggaguucgcugcaggcaggcggucagugaguggggaccugauccucgagaucggaaaacuuccacagcaccugaccuuacgagcccagaaugcuuuggauaaccuggugaugcuccacaauucugaacagggcgguaaggccuacagacaugcaauggaggaacugcccgacacaauugagacucuuaugcugcucgcguugauagccguccugaccgggggcguuacauuauuuuuccuauccggaaagggccuggggaaaaccagcaucggacuccuuugugugacugcuucaagugcccuguuguggauggcaagcguagagccucacuggauugcugccuccaucauucuggaauuuuuccucauggugcugcuuauccccgagccagaucgccaaaggacaccucaggacaaccagcucgcauaugucgugauaggucuguuguuuguuauccugacgguggccgcuaacgaaaugggcuuacuagagaccacuaagaaagaucuggggauuggacaugucgcggccgagaaucaccaacacgcaacaaugcucgacguagaucuucggcccgcuucugccuggacccuguacgccguggcaaccacaguuaucacuccaaugaugcgucauacgauugaaaacaccacagcuaauaucagcuugacugccauagcgaaccaggcugccauucugaugggccucgacaaggguuggccuaucuccaaaauggauauuggggugccgcugcuugcauuaggcugcuacucacaggucaauccccugacccucacagccgcuguguugaugcuggucgcacacuaugccaucauaggaccaggccuacaggcgaaggcuaccagagaggcccaaaagaggacugcagccgggaucaugaaaaacccuacgguggacggaauuguugcuaucgaucuggaccccgugguauacgacgccaaguucgaaaaacagcucggccagauuaugcuucugaucuuguguacaucucagauacugcucaugcgcaccacuugggcacugugcgagaguauuaccuuagcuacagguccacuuacuacccugugggaagggucgccuggaaaguuuuggaauacaacgaucgccgugagcauggcgaacaucuuccggggcuccuaucucgccggugcaggccuagcuuucucucugaugaaaucacuagggggaggccgaagagggaccggagcccaaggcgagacucugggugagaaguggaagaggcagcucaaucagcuuagcaaauccgaauuuaacacauacaagcgcagugggauuauggaggucgaucggucugaagcaaaagagggacugaagagaggcgaaaccacuaaacaugcuguuagccgugguacagccaaguugaggugguucguggagcggaaucuggucaagcccgagggcaaagugaucgaccucggguguggacgcggcggguggucauauuacugcgccggauuaaagaaaguaaccgaagugaagggcuauacgaaaggugggccgggacacgaggaaccaauaccuauggcgaccuacggcuggaaccugguuaaacuucauuccggcaaagauguguuuuucaugcccccagagaagugugacacacugcuaugcgauauuggggaaaguagccccaauccuacuaucgaggagggacgaacccucagaguccugaagaugguggaaccgugguugagggguaaccaguuuuguauuaaaauccugaaucccuacaugccaucugucguggagacacucgaacaaaugcagcggaagcacggcgggaugcuuguucgcaacccucuguccagaaauucaacucacgagauguauuggguaagcugcggaaccggcaacauagugucggcugucaacaugacaucuaggauguuacugaaucgauucaccauggcacaucggaaacccacuuacgagcgugacguggauuugggugccgggacgagacacguugcuguggaaccugaggucgccaaccucgacaucauuggacagcgcaucgaaaauauuaagaacgagcauaaaaguacauggcacuaugaugaagacaauccauacaagaccugggcauaucacggcuccuacgaggugaagcccagcggcucagccuccucuaugguaaacggggugguuaggcugcuaacuaaaccuugggaugucaucccaauggugaagcaaauugcuaugaccgacacaacgcccuuuggacagcagcggguguucaaagagaaggucgacaccagaacuccgcgcgcgaaaagggguacaacccagaucauggaaguuacugccaaguggcuuuggggcuuucugagccgaaauaagaaaccucggauauguacaagagaggaguucaccaggaaggugcgcaguaacgcagcuauuggggccguauuugugggagagaaucaauggaacuccgcaaaagaagccgucgaggaugagcgugugugggaccucguucaucgggaaagagagcugcacaagcagggcaaaugcgcuacaugcguguauaauaugauggguaagagggaaaagaaauugggggaguucggaaaggccaaaggcagccgcgcgaucugguacauguggcugggcgcacgauuucucgaguucgaggcccuuggguucaugaacgaggaucauugguuuucucgggaaaauucacugaguggagucgagggugaaggcuuacacaagcugggguacaucuugagagacauuuccaaaauaccaggaggcaacauguaugcugaugacacugccgguugggauaccaggaucacggaggacgaucuccagaaugaggcaaagauuaccgaaaucauggagcccgaacaugcucugcuagccacaagcauuuucaaacuuacuuaccagaacaaggugguacgcguucaaagaccugcuaagaacgggaccgugauggacgucaucucucggagggaucagcguggaucgggccaggugggcacauaugggcugaauacuuuuaccaacauggaggugcagcucauacgacaaauggaaucagagggaaucuuccugccaagcgaguuggaaacgcccaauuuagccgagcgcguccuggacuggcucgaaaaacacggugcagagagacuuaagcggauggcgauuuccggcgaugacuguguugugaaaccgaucgacgauagguuugccacagcucugaccgcccuaaacgacauggggaagguacgcaaagauauuccucagugggaacccaguaagggauggaaugacuggcaacaggugccauucugcucucaccauuuucaccaacugaucaugaaggauggcagagagauagucgugccuugucggaaccaggacgagcucguugguagggcacgagugagccagggggcuggaugguccuugcgugaaacugccugccugggcaaaucauacgcacaaauguggcagcuuauguauuuccauagacgcgaucugcggcucgccgcgaaugcuauuuguagugccguccccguggacuggguaccaacaucuaggaccacuuggagcauccacgcacaccaucaguggaugaccacagaggauauguuauccguuuggaacagaguguggaucgaagagaaucccuggauggaagacaagacgcacgucucaagcugggaggaggugccuuaccugggcaaacgcgaagaucaguggugcgggucuuugauuggacugaccgcccgggcuacuugggccacaaacauacaaguugcaaucaaucaggugaggcgacucauugguaacgagaauuaucuugacuacaugaccuccaugaagagauuuaaaaacgaaagugacccagagggcgcucugugguga

SEQ ID NO: 13327 - RNA, 9879 nt, Artificial Sequence
  derived and/or modified CDS sequence (opt3) from DENV-1__GU131961__SS-prME
agcgugaccaugcugcucaugcuucugcccacagcauuggcuuuccacuuaacuacgaggggaggggagccucauaugaucgucuccaagcaggaaaggggaaaaucucuguuauuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacuuuggauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuuccguuuggagaaagaaguggcugagacccagcacgguacgguccuggugcaaguuaaguacgagggcacagaugcgccuugcaagaucccauucagcacccaggacgaaaaaggggugacucagaacggacgccucauuacagcaaaucccaucguaaccgauaaggagaaaccugucaacauagaaacugagccacccuuuggcgagucguauauugugguuggugccggggaaaaggcucugaaacuuucuugguucaagaagggcuccucaaucggaaaaauguuugaggccaccgcaagaggcgccaggcggauggcuauccugggggacacagccugggauuucggaaguauugguggcguguuuacgagcgucgggaaguuggugcaucagguauucggaaccgcauacggcgugcucuuuuccgguguuucuuggacuaugaaaaucgggauuggcauacuguuaacauggcugggacuaaauagccgaucaaccagucucuccaugacauguaucgcggucggcauggugacucuguaccuuggggugaugguccaagcugacagcggaugcguuauuaacuggaagggccgcgaauugaaaugugguucugggaucuucgugaccaacgaggugcacacguggacagaacaguauaaguuucaggccgauucaccgaagagacugagugcagccaucggaaaggcuugggaggagggcguaugcgguauuaggagcgccacccggcucgaaaauauaauguggaagcagaucuccaacgagcugaaucauauuuuacuggaaaacgacaugaaauucacugucgugguuggcgacgcaaaugggauccuugcucaaggaaagaaaaugauucgcccucagcccauggagcacaaguacucuuggaaaucguggggcaaggccaagaucauaggggcggauauccagaacaccacauuuauuaucgacggaccagauacuccugaaugucccgacaaucagagagccuggaacauuugggagguggaggauuauggcuucgguaucuuuaccacaaauauaugguugaaacucagggacagcuacacgcaaaugugcgaucaccgucugauguccgcugcaauuaaggacucaaaagccguccaugcugauaugggguauuggaucgaaagugagaagaacgaaaccuggaaacuagcccgggcaucuuucauugaggugaagacuuguacauggccaaagagccacacccugugguccaauggaguucucgaaucagagaugaucauacccaaaaucuacggcgguccuauuagccagcauaacuaucgaccaggcuacuucacucagacagcggggccguggcaccugggaaaacuugaguuggacuuugaucugugcgaaggcaccacggugguagucgacgagcacugcgggaauagaggacccucuuuaaggacuaccacagugaccggcaaaaucauucaugaaugguguugccgcuccuguacucucccuccacugcgguucagaggugaggaugggugcugguacggaauggagaucaggcccgugaaggaaaaagaggaaaaccuuguccgcaguaugguuagcgccggcucuggugagguggacuccuuuucacugggcauauugugugcuaguauuaugaucgaagagguaaugcgaagccgguggucgcguaagaugcucaugacagggacccuggccguguuccuacugcucaucaugggacaacugacauggaaugaccuuauuagauugugcaucauggucggcgcaaacgcuuccgauaggauggggaugggaacuaccuaucuggccuuaauggcaacguuuaagaugcgcccuauguucgccgugggccuccuguuucggagacuuacaucuagggagguucugcuacucaccauuggucugagcuugguggcuucagucgaacugccaaacaguuuagaggaacucggggacggacuggcgaugggcauaaugaugcuuaaacuguugacugaguuccagccccaccagcucuggaccacacugcuaucccugacuuuuaucaagaccacgcuuucucucgauuacgccuggaaaacaaccgcaauggcucugagcauuguguccuuguucccgcuguguuuaucaacuacaagccagaagaccacuuggcucccuguucugcuuggcaguuuugggugcaaaccacugacaauguucuugaucaccgaaaauaagauuuggggacgaaagucuuggccccucaacgaggguaucauggccauaggcaucguguccauucugcuaagcucgcugcuuaaaaaugacgucccucucgccgggccccugaucgcuggaggcauguugauugcauguuauguaaucucagguucuagugccgauuuaucccuggagaaggcggcugaagugagcugggagcaagaagccgagcauucugggacgagccacaacauacucguugaagugcaggacgauggaacuaugaaaauuaaggacgaggagcgcgaugacacccugacaauccuucugaaagcaaccuugcuagccgucuccggcguguacccaaugucaaucccugcuacacuguuuguaugguauuucuggcagaagaaaaagcagcggaguggcgugcucugggauacucccagcccaccggaagucgagagagcaguucuggacgaugggauuuacaggauacuucaacguggauuacugggucgcucucaggugggcgugggggucuuccaggacggaguguuucauaccauguggcacguuacgcggggcgccguacucauguaucaggguaagagauuggaaccuuccugggcgucagugaaaaaggaccugaucaguuacgggggaggcuggagguuccaaggcagcuggaauacaggggaggagguccaggugauugcuguugaacccggcaagaacccaaagaaugugcagacuacccccgguacauuuaaaaccccugagggcgaagucggggccaucgcacucgauuucaagccaggaacuuccggcucucccauugugaaccgagaggguaagaucguagggcuguacggaaauggcgucgugaccacaucgggcacguauguuagcgccauagcucaagccaaagcaucacaggaagggccucuuccggagaucgaggacgaaguguuuaagaaacggaaccugacuauuauggauuugcacccaggauccgguaagacccgcagauaccuacccgcuaucgucagggaggccauuaaacggaagcugcgaacacucaucuuagcgccuaccagagugguugccagugaaauggcagaggcucugaagggcaugccaauacgcuaucagacuacagccgugaaaucugaacauaccgggagggagauugucgaccuuaugugccacgcuacguucacuaugcgucugcucagccccgugcggguaccuaauuacaacaugaucaucauggaugaggcacauuuuacagacccggccuccauugccgcuagaggauauaucucaaccagggugggcaugggugaagcggcagccauauucaugaccgcuacucccccagggucuguugaggccuuuccucagagcaaugcagucauucaagaugaagaacgcgacauccccgaacgaaguuggaacuccggauacgauuggauuacagacuucccaggcaagaccgugugguuugugccuagcaucaaaucuggcaaugauauagccaacuguuugagaaagaacgggaaacgggucauucagcugucaaggaagacauucgacacugaguaucagaagacgaaaaauaacgacugggauuacguagugaccacagacaucuccgagaugggagcuaauuuccgcgcggaucguguuaucgaccccagacggugccucaagccagugauucugaaagaugguccggaaagggucauccuugccggcccuaugcccgugacuguugcaagugcugcccagcgccgagggagaauuggacggaaccaaaauaaggagggcgaccaguacguguauaugggucagccacuaaacaaugaugaagaccacgcacauuggaccgaggccaaaaugcuguuggauaacauaaauacacccgaggggaucauuccugcuuuauuugaaccagagagggaaaagagcgccgcgaucgacggcgaguaccgccugagaggagaagcaaggaagaccuucgucgagcucaugcggcguggcgaucugcccguguggcuuucguauaaaguagccucugagggguuucaguacuccgaccgccgauggugcuucgauggagaaagaaacaaucaagugcuggaggaaaacauggacguugagaucuggacuaaggaaggugagaggaaaaagcuccggccucgcugguuggacgcuagaacguauagcgauccgcuggcccuaagggaguuuaaagaguucgcugcaggccggcgaucagucaguggggaccugauucucgagauaggaaaacuuccacagcaccugaccuuaagagcccagaaugcuuuggauaaccuggugaugcuccacaauucugaacagggcgguaaagccuaccgccaugcaauggaggaacugcccgacacaaucgagacucuuaugcugcucgcguugauugccgugcugaccgggggcgucacauuauuuuuccuauccggaaagggccuggggaagaccagcaucggacuccuuuguguuacugcuucaagugcccuguuguggauggcaagcguggagccucacuggauugcugccuccaucauacuggaauuuuuccucaugguacugcuuauccccgagccagauaggcaacggacaccucaggacaaccagcucgcauauguggucauuggucuguuguuuaugauccugacgguggccgcuaacgaaaugggcuuacuagagaccacuaaaaaggaucuggggauuggacauguugcggccgagaaucaccaacacgcaacaaugcucgacguggaucuucgucccgcuucugccuggacccuguacgccgucgcaaccacaguaaucacuccaaugaugagacauacgauagaaaacaccacagcuaauauuagcuugacugccaucgcgaaccaggcugccauucugaugggccucgacaaagguuggccuaucuccaagauggauauaggggugccgcugcuugcauuaggcugcuacucacagguuaauccccugacccucacagccgcuguguugaugcuggucgcacacuaugccaucauuggaccaggccuacaggcgaaagcuaccagggaggcccaaaagcgcacugcagccgggaucaugaagaacccuacgguggacggaauugucgcuaucgaucuggaccccgugguuuacgacgccaaauucgaaaagcagcucggccagauaaugcuucugauuuuguguacaucucagauccugcucaugcggaccacuugggcacugugcgagaguaucaccuuagcuacagguccacuuacuacccugugggaagggucgccuggaaaauuuuggaauacaacgauugccgugagcauggcgaacaucuuccgaggcuccuaucucgccggugcaggccuagcuuucucucugaugaagucacuagggggaggcagaagggggaccggagcccaaggcgagacucugggugagaaauggaagcgccagcucaaucagcuuagcaaguccgaauuuaacacauacaaacggagugggauaauggagguagauagaucugaagcaaaggagggacugaaacguggcgaaaccacuaagcaugcugugagcagggguacagccaaauugcggugguucgucgagcgcaaucugguuaagcccgagggcaaggugauugaccucggguguggacgaggcggguggucauauuacugcgccggacugaaaaaggucaccgaagugaaaggcuauacgaagggugggccgggacacgaggaaccaaucccuauggcgaccuacggcuggaaccuaguaaaacuucauuccggcaaggauguguuuuucaugcccccagagaaaugugacacacugcuaugcgauauuggggaaaguagccccaauccuacuaucgaggagggaagaacccucaggguucugaagaugguggaaccgugguugcgggguaaccaguuuuguauaaagauccugaaucccuacaugccaucugucguggagacacucgaacaaaugcagcgcaaacacggcgggaugcuugucagaaacccucuguccagaaauucaacucacgagauguauugggugagcugcggaaccggcaacauuguuucggcuguaaacaugacaucucgaauguuacugaaucgguucaccauggcacaucguaagcccacuuuugagagagacguggauuugggugccgggacgcgccacgucgcuguggaaccugagguugccaaccucgacaucauuggacagaggaucgaaaauauuaaaaacgagcauaagaguacauggcacuacgaugaagacaauccauauaaaaccugggcauaccacggcuccuaugaggugaagcccagcggcucagccuccucuauggucaacggggugguacggcugcuaacuaagccuugggaugugaucccaaugguuacccaaauagcuaugacagacacgacccccuucggacagcagagagucuuuaaagagaagguggacacucgcacaccgagggcgaaacgagguaccacucagauuauggaagugacagccaaguggcuuuggggcuuccugagccggaauaaaaagccuagaaucuguaccagggaggaauuuacacgcaagguccguaguaacgcagcuaucggggccguuuucguggaugagaaucaauggaacuccgcaaaagaagccguagaggacgagcgguuuugggaucucgugcauagagaaagggagcugcacaagcagggaaaaugcgcuacuugcgucuacaauaugaugggcaagcgcgagaaaaaguugggugaguucgggaaggccaaaggaagccgagcgauuugguauauguggcugggcgcacgguuccucgaauuugaggcccuuggcuucaugaacgaggaccauugguuuucuagagaaaauucacugagugggguggagggagaagguuuacacaagcugggcuacauauugagggauaucuccaaaauuccagggggaaacauguacgcugacgauaccgccggcugggacacgcgcaucaccgaggaugaccuccagaaugaggcaaagauuacagauaucauggaacccgagcaugcucugcuagccacuagcauauucaaacuuaccuaucagaacaagguugugagaguccaacggccugcuaaaaacgguacagugauggacguaaucucuaggcgugaucagcgagggucgggacagguuggcacuuacggccugaauaccuuuacgaacauggaagugcagcucauucgccaaauggagucagaagggaucuuccugccaagcgaguuggagacacccaauuuagccgaaagaguccuggacuggcucgagaagcacggagcagaacggcuuaagaggauggcgauuuccggugacgauuguguggugaaaccgaucgacgaucgcuuugccaccgcucugacugcccuaaacgacaugggcaaggucagaaaagauauaccucagugggagcccaguaagggguggaaugacuggcagcagguuccauucugcucucaccauuuucaccaacugauuaugaaagauggacgggaaaucgugguaccuuguaggaaccaggacgagcucgugggccgagcacgugucagccagggugcugggugguccuugagagagacagccugccugggaaagucauaugcacaaauguggcagcuuauguacuuccaucgccgggaucugaggcucgccgcgaaugcuaucuguagugccgugcccguugacugggugccaaccucuagaacuaccuggagcauucacgcacaccaucaguggaugacaacggaagauauguuauccgucuggaaccgcguguggauagaggaaaaucccuggauggaggacaagacccacguaucaagcugggaagagguuccuuaucugggcaaacgggaggaccaguggugcggcucuuugaucgggcugacugccagggcuacaugggccaccaacauucaaguggcaaucaaucagguccgaagacucauuggaaacgaaaauuaccuugauuauaugacuuccaugaagcgguuuaaaaacgagagugacccagaaggugugcugugguga

SEQ ID NO: 13328 - RNA, 9870 nt, Artificial Sequence
  derived and/or modified CDS sequence (opt3) from DENV-1__GU131962__SS-prME
agcgugaccaugcugcucaugcuucugcccacugccuuggcuuuccacuuaacuacgagaggaggggaaccucauaugaucgucuccaagcaggaaaggggaaaaucucuguuguuuaagaccucagcugguguuaacaugugcacacucauugccauggaccugggcgaacuuugugaagauacuaugaccuacaaaugcccacagauuacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuaccgaauacuucaaaggggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaaaaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaucgggcacguaugucagcgcaaucgcccaagcuaaggccucacaggaagggccucuuccggagauagaggacgaaguguuuaaaaagcgaaaccugacuaucauggauuugcacccaggauccgguaaaacccggcgcuaccuacccgcaauuguuagagaggcuaucaagaggaagcugcggacacucauuuuagccccuacccgaguggucgcgagugaaauggccgaggcacugaaaggcaugccaaucagauaucagacuacagcugugaagucugaacauaccgggcgcgagauaguagaccuuaugugccacgccacguucacuaugaggcugcucagccccgugcguguuccuaauuacaacaugauuaucauggaugaggcucauuuuacagacccggcauccaucgccgcccggggauauauuucaaccagagucggcaugggugaagcugcggcaaucuucaugaccgccacucccccagggucuguggaggcuuuuccucagagcaaugccgugauacaagaugaagagagggacauucccgaacgcaguuggaacuccggauacgauuggaucacagacuucccaggcaaaaccgucugguuuguaccuagcauuaagucuggcaaugauaucgcaaacuguuugcggaaaaacgggaagagagugauacagcugucaagaaagacauucgacacugaguaucagaaaacgaagaauaacgacugggauuacguugugaccacagacauuuccgagaugggagccaauuucagggcugaucgcgucaucgacccccguagaugccucaaaccagugauccugaaggaugguccggaacggguuauucuugcgggcccuaugcccgugacugucgccagugcagcucagaggcgcgggcgaaucggaagaaaccaaaauaaagagggcgaccaguacguguauaugggucagccacuaaacaaugaugaagaccacgcccauuggaccgaggcaaagaugcuguuggauaacauuaauacacccgaggggauaaucccugccuuauuugaaccagagcgggaaaagagcgcugccauugacggcgaguacaggcugcgcggagaagcgagaaaaaccuucguagagcucaugaggcggggcgaucugcccguguggcuuucguauaagguugcaucugagggguuucaguacuccgaccgucgcuggugcuucgauggagaacgaaacaaucaaguccuggaggaaaacauggacguggagaucuggacuaaagaaggugagagaaagaaacucaggccucggugguuggacgcccgcacguauagcgauccgcuggcucuaagagaguuuaaggaguucgccgcuggcaggcggucagugaguggggaccugauccucgagauuggaaaacuuccacagcaccugaccuuacgagcacagaaugccuuggauaaccuggucaugcuccacaauucugaacagggcgguaaggcuuacagacaugccauggaggaacugcccgacacaauagagacucuuaugcugcucgcauugaucgcgguucugaccgggggcgugacauuauuuuuccuauccggaaagggccuggggaaaaccagcauuggacuccuuuguguaacugccucaagugcucuguuguggauggccagcguggagccucacuggaucgcagcuuccauuauccuggaauuuuuccucaugguccugcuuauacccgagccagaucgccaaaggacaccucaggacaaccagcucgccuaugugguuaucggucuguuguuuaugauucugacgguggcagccaacgaaaugggcuuacuagagaccacuaagaaagaucuggggaucggacaugucgcugcggagaaucaccaacacgccacaaugcucgacguagaucuucggcccgcaucugcuuggacccuguacgccguggccaccacaguuauuacuccaaugaugcgucauacgaucgaaaacaccacagcaaauauuagcuugacugcuauugccaaccaggcggcuauccugaugggccucgacaaggguuggccuauuuccaaaauggauaucggggugccgcugcuugccuuaggcugcuacucacaggucaauccccugacccucacagcagccguguugaugcuggucgcucacuaugcaauaaucggaccaggccuacaggccaaggcgaccagagaggcucaaaagaggacugccgcagggauuaugaaaaacccuacgguggacggaaucguugccauugaucuggaccccgugguauacgacgcuaaguucgaaaaacagcucggccagaucaugcuucugauauuguguacaucucagauucugcucaugcgcaccacuugggcccugugcgagaguaucaccuuagcaacagguccacuuacuacccugugggaagggucgccuggaaaguuuuggaauacaacgaucgcugugagcauggccaacauuuuccggggcuccuaucucgcgggugccggccuagcauucucucugaugaaaucacuagggggaggccgaagagggaccggagcucaaggcgagacucugggugagaaguggaagaggcagcucaaucagcuuagcaaauccgaauuuaacacauacaagcgcagugggaucauggaggucgaucggucugaagccaaagagggacugaagagaggcgaaaccacuaaacaugcaguuagccgugguacagcuaaguugaggugguucguggagcggaaucuggucaagcccgagggcaaagugauagaccucggguguggacgcggcggguggucauauuacugcgccggauuaaagaaaguaaccgaauaugccuccgcgggccuggcuauuaucgugccgcuuccacuggauacguacggucgaaacagacuaaagauucacagugggaaagacguauuuuucaugccucccgagaagggagauacccuccugugugacaucggcgaaagcucuccaaaucccacaauagaggaaggcaggacuuugcgggugcugaaaauggucgagccuuggcuccgcgggaaccaguuuugcaucaagauucuuaauccguacaugcccuccguggucgaggcacuggaacaaaugcagagaaagcauggagguauguuagugaggaacccacugucacgaaauagcacccacgagauguauuggguuucguguggcacagggaacaucguaucugccgugaacaugacaagucggauguugcucaaucguuucaccauggcucacagaaaaccuacauacgaacgcgaugucgaccugggagccggcaccaggcauguggcaguugagcccgagguggccaaccuagauauuaucggucagcggauugaaaauaucaagaacgagcacaaauccacuuggcauuaugacgaagauaauccuuacaagacgugggcuuaucacgggagcuacgaggucaaaccaucaggauccgcgucuagcauggugaacggcguagugagacuucugacaaagcccugggacguuauaccuauggucacccaaauugccaugacugacaccacaccauuuggccagcagcgcguguucaaggaaaaaguggauacgaggaccccacgagcaaagcgggggacuacacagaucauggaggucaccgcuaaauggcucuggggauuucugaguagaaauaagaaaccgaggaucugcacucgcgaggaguucacacguaagguucgguccaacgccgcaauuggugccguguuuguagacgagaaucaauggaacagcgcuaaggaagccguggaggaugaaagauucugggacuugguccacagggagcgcgagcugcauaaacagggcaagugugcgaccugcguguauaauaugauggggaaacgagaaaagaaacucggagaguuuggcaaggcaaaggguucucgggccauaugguacauguggcuuggggcuagauuccuggaguucgaggccuuaggauuuaugaacgaagaucacugguucucaagggagaauagucuguccggcguugagggcgaaggguugcauaaacucggauacauccugcgcgacauuagcaagaucccugguggcaacauguaugcagaugacacagcugggugggauacuagaauuaccgaggacgaucuacagaaugaagccaaaaucacggagauaauggagccagaacacgcacuucuggccaccucuaucuuuaagcucacauaccagaacaaagugguccgggugcaaaggcccgcaaagaacggaacuguaauggacguuauuucgcgucgagaucagcgcggcucaggucagguggggaccuauggacugaauacauucacuaacauggagguccaguugaucagacaaauggaaagcgagggcauauuuuuaccuuccgaacuggagaccccaaaucucgcggagcgggugcuugacuggcuggaaaaacauggcgccgagaggcuaaagcgcauggcuaucaguggggacgauugcguggucaagcccauagacgauagauucgccacggcacugacagcucucaacgacaugggaaaaguucggaaggauauuccgcagugggaaccuucuaaagguuggaaugacuggcaacaggugcccuuuuguagccaccacuuccaucaauugaucaugaaggauggcagggagaucguagugccaugccgaaaccaggacgaacuggucgggcgugccagagugucccagggagcaggcuggucacuucgcgagaccgccugucuggguaaaaguuacgcgcaaauguggcagcucauguauuuucaccggagggauuuaagacuggcugccaaugcaauuugcucugccguuccuguggacuggguccccacuagccgcacaaccugguccauacaugcucaccaccaguggaugacuaccgaggauauguugucaguguggaaccggguauggaucgaagagaauccauggauggaagacaagacacauguuagcucuugggaggaagugcccuaccuggggaagagggaggaccagugguguggaucccucauuggccuuacggcccgagcaaccugggcuacuaacauccaagucgccauuaaucaggugagacggcugaucggcaacgagaauuaucuagauuacaugacaaguaugaaaagguucaagaacgaaagcgacccugagggggcgcugugguga

SEQ ID NO: 13329 - RNA, 9879 nt, Artificial Sequence
  derived and/or modified CDS sequence (opt3) from DENV-1__GU131963__SS-prME
agcgugaccaugcugcucaugcuucugccaacggccuuggcuuuccacuuaacuacgagaggaggggaaccucauaugaucgucuccaagcaggaaaggggaaaaucucugcuguuuaagaccucagcugguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcauuuuuccuggcccaugcuaucggcacaucgauuacccaaaagggcaucauauuuauccucuuaaugcuggugacgccaucaauggccaugcggugcgucgggauuggaaaccgcgauuucguggagggucuuagcggcgcgacuuggguagacguuguguuggagcacgggaguugugucacaaccauggcaaagaauaaacccacucuggauaucgaacuacucaagacagaggugaccaacccugccauucugagaaaacuuugcaucgaagcuaagauauccaauacgaccacagacucuagguguccaacucagggagaggccacccugguggaagaacaggaugcaaacuuugucugccggcgcacauucguugaccgaggcugggguaauggguguggauuguuuggcaaaggcagccuccugacuugcgcuaaguucaagugcgugaccaaauuagaggggaagauuguacaguacgaaaaccugaaauauuccgugaucgucacagugcacaccggagaucaacaucagguugguaaugagacuacggaacacggcacaauugccaccaucacuccccaggcgccuaccucagagauccagcucacagacuacggggcccuuacccuggacuguaguccaagaacuggauuggauuuuaacgaaauggugcuacugacaaugaaggagaaaagcuggcucguccauaagcaaugguuccuggaccuuccgcugcccuggacgucuggcgcauccaccucacaggagacuuggaauaggcaggauuugcucgugacauuuaaaaccgcucacgccaagaagcaagaaguaguugugcuggguagccaggagggggcuaugcacacagccuuaacuggcgcaaccgaaauucagacgaguggaaccacaacuauauucgccggccaucugaaaugccggcuaaagauggacaaacucacccugaaggggacaucuuaugucauguguacuggauccuucaaacuugagaaggaaguggcugagacccagcacgguacggucuuggugcaaguuaaguacgagggcacagaugcgccuugcaaaaucccauuuagcacccaggacgaaaagggggugacucagaacggacgucugauuacagcaaaucccaucguaaccgauaaagagaagccugucaacauagaaacugagccacccuucggcgagucguauauugugguuggugccggggaaaaagcucucaagcugucuugguuuaagaaaggcuccucaaucggaaagauguucgaggccaccgcacgcggcgccagaaggauggcuauccuuggggacacagccugggauuuuggaaguauugguggcguguucacgagcgucgggaaacuggugcaucagguauuuggaaccgcauacggcguguuguucuccgguguuucuuggacuaugaagaucgggauuggcauacuccugacaugguuaggacugaauagccggucaaccagucuauccaugacauguaucgcggucggcauggugacucucuaccugggggugaugguccaagcugacagcggaugcguuauuaacuggaaaggccgagaacuuaagugugguucugggaucuuugugaccaacgaggugcacacguggacagaacaguauaaguuccaggccgauucaccgaaacgcuugagugcagccaucggaaaggcuugggaggagggcguaugcgguauuagaagcgccaccaggcuggaaaauauaauguggaaacagaucuccaacgagcucaaucauauucuguuagaaaacgacaugaaguuuacugucgugguuggcgacgcaaaugggauccuggcucaaggcaagaagaugauucggccucagcccauggagcacaaauacucuuggaagucguggggcaaggccaaaaucauaggggcggauauccagaacaccacauucauuaucgacggaccagauacuccugaaugucccgacaaucagcgcgccuggaacauuugggagguggaggauuauggcuuugguaucuucaccacaaauauauggcuuaaguugagagacagcuacacgcaaaugugcgaucacaggcucauguccgcugcaauuaaagacucaaaggccguccaugcugauaugggguauuggaucgaaagugagaaaaacgaaaccuggaagcuggcccgugcaucuuucauugaggugaagacuuguacauggccaaaaagccacacccuaugguccaauggaguucuggaaucagagaugaucauacccaagaucuacggcgguccuauuagccagcauaacuaucggccaggcuacuuuacucagacagcggggccguggcaccucggaaaacuggagcuugacuucgauuugugcgaaggcaccacggugguagucgacgagcacugcgggaaucgaggacccucucugagaacuaccacagugaccggcaagaucauucaugaaugguguugcagguccuguacuuuaccuccacuccgcuuucggggugaggaugggugcugguacggaauggagaucagacccgugaaagaaaaggaggaaaaccuggucaggaguaugguuagcgccggcucuggugagguggacuccuucucacuuggcauacuguguguaaguauuaugaucgaagaggugaugcgcagccgauggucgcggaagauguugaugacagggacccucgcugucuuucugcuacuggugaugggacaacucacauggaaugaccugauccgucuuugcauuaugguuggcgccaacgcauccgauagaauggggaugggaacuaccuauuuggcucugauggccacguucaaaaugaggccuauguuugcagugggcuuacucuuccgccggcugacaucuagagagguccuucugcuaaccaucggucucagccugguggccucaguugaauugccaaacagucuggaggaauuaggggacggacucgcuaugggcauuaugaugcugaaacuucugacugaguuucagccccaccaguuguggaccacacuccugucccuaacuuucauaaaaaccacgcugucucuugauuacgcguggaagacaaccgccauggcacucagcaucgugucccuguuuccguugugucugucaacuacaagccagaaaaccacuugguuaccuguccuccugggcaguuucgggugcaagccacuuacaauguuucugauuaccgaaaauaagaucuggggaaggaaaucuuggcccuugaacgaggguauuauggcuaucggcauaguauccauccuccugagcucgcuacugaagaaugacgugccucuugccgggccccucauugccggaggcaugcugaucgcuuguuauguuauuucagguucuagugcagauuuguccuuagagaaagccgcggaagugagcugggagcaagaagcugagcauucugggacgagccacaacauccuggucgaagugcaggacgauggaacuaugaagauaaaagacgaggagcgagaugacacccucacaauucugcuuaaggccacccuguuggcaguauccggcguguacccaaugucaaucccugccacacuauucgucugguauuucuggcagaaaaagaagcagcgcaguggcguucugugggauacucccagcccaccggaaguggagcgggcugugcucgacgaugggaucuacaggauucugcaacgaggacuuuuaggucguucucaggucggcguggggguuuuucaggacggaguauuccauaccauguggcacgugacgcgcggcgcaguccugauguaucaggguaaacggcucgaaccuuccugggccucagugaagaaagacuugauaaguuacgggggaggcuggagauuucaaggcagcuggaauacaggggaggagguucaggugaucgcggucgaacccggaaagaaccccaaaaaugugcagacuacccccgguacauucaagaccccugagggcgaaguaggggcuauugcccuggauuuuaagccaggaacuuccggcucucccaucgucaacagggaggguaaaauuguggggcucuacggaaauggcguugugaccacaucgggcacguaugucagcgcaaucgcccaagcuaaggccucacaggaagggccucugccggagauagaggacgaaguguucaaaaagcgaaaccuuacuaucauggaucugcacccaggauccgguaaaacccggcgcuacuugcccgcaauuguuagagaggcuaucaagaggaagcuacggacacugauucucgccccuacccgaguggucgcgagugaaauggccgaggcauuaaaaggcaugccaaucagauaucagacuacagcugugaagucugaacauaccgggcgcgagauaguagaccugaugugccacgccacguuuacuaugaggcuucugagccccgugcguguuccuaauuacaacaugauuaucauggaugaggcucauuucacagacccggcauccaucgccgcccggggauauauuucaaccagagucggcaugggugaagcugcggcaaucuuuaugaccgccacucccccagggucuguggaggcuuucccucagagcaaugccgugauacaagaugaagagagggacauucccgaacgcaguuggaacuccggauacgauuggaucacagacuuuccaggcaaaaccgucugguucguaccuagcauuaagucuggcaaugauaucgcaaacugucucagaaagaacgggaaaagagugauacaguugucacggaagacauucgacacugaguaucagaaaacgaagaauaacgacugggauuacguugugaccacagacauuuccgagaugggagccaauuuuagggcugaucgcgucaucgacccccguagaugccugaaaccagugauccucaaggaugguccggaacggguuauucuggcgggcccuaugcccgugacugucgccagugcagcucagaggcgcgggcgaaucggaagaaaccaaaauaaagagggcgaccaguacguguauaugggucagccacuuaacaaugaugaagaccacgcccauuggaccgaggcaaagaugcuacuggauaacauuaauacacccgaggggauaaucccugccuuguucgaaccagagcgggaaaagagcgcugccauugacggcgaguacagguuacgcggagaagcgagaaaaaccuuuguagagcugaugaggcggggcgaucuccccguguggcugucguauaagguugcaucugagggguuccaguacuccgaccgucgcuggugcuuugauggagaacgaaacaaucaaguccuugaggaaaacauggacguggagaucuggacuaaagaaggugagagaaagaaacugaggccucgguggcucgacgcccgcacguauagcgauccguuggcucugagagaguucaaggaauuugccgcuggcaggcggucagugaguggggaccuaauccuggagauuggaaaacucccacagcaccuuacccugcgagcacagaaugccuuagauaacuuggucaugcugcacaauucugaacagggcgguaaggcuuacagacaugccauggaggaacuccccgacacaauagagacucugaugcuucuggcacucaucgcgguuuugaccgggggcgugacacuguucuuuuuauccggaaagggccuagggaaaaccagcauuggacugcucuguguaacugccucaagugcacuucuguggauggccagcguggagccucacuggaucgcagcuuccauuaucuuggaguucuuucugaugguccuccugauacccgagccagaucgccaaaggacaccucaggacaaccagcuugccuaugugguuaucggucuccuguucaugauuuugacgguggcagccaacgaaaugggccuguuagagaccacuaagaaagaucuagggaucggacaugucgcugcggagaaucaccaacacgccacaaugcuggacguagaucuccggcccgcaucugcuuggacccuuuacgccguggccaccacaguuauuacuccaaugaugcgucauacgaucgaaaacaccacagcaaauauaagccugacugcuauugccaaccaggcggcuaucuugaugggccuggacaaggguuggccuauuuccaaaauggauaucggggugccgcuccuggcccuuggcugcuacucacaggucaaucccuuaacccugacagcagccgugcucauguuggucgcucacuaugcaauaaucggaccaggccugcaggccaaggcgaccagagaggcucaaaagaggacugccgcagggauuaugaaaaacccuacgguggacggaaucguugccauugaucuagaccccgugguauacgacgcuaaguuugaaaaacagcugggccagaucaugcuccuuauacuguguacaucucagauuuugcugaugcgcaccacuugggcccucugcgagaguaucacccuggcaacagguccauuaacuacccuuugggaagggucgccuggaaaguucuggaauacaacgaucgcugugagcauggccaacauuuuccggggcuccuaucuggcgggugccggccucgcauuuucucuaaugaaaucacuagggggaggccgaagagggaccggagcucaaggcgagacuuugggugagaaguggaagaggcagcugaaucagcucagcaaauccgaguucaacacauacaagcgcagugggaucauggaggucgaucggucugaagccaaagagggacuuaagagaggcgaaaccacuaaacaugcaguuagccgugguacagcuaagcugaggugguuuguggagcggaauuuggucaagcccgagggcaaagugauagaccugggguguggacgcggcggguggucauauuacugcgccggacucaagaaaguaaccgaagugaagggcuauacgaaaggugggccgggacacgaggaaccaauuccuauggccaccuacggcuggaacuuaguuaagcugcauuccggcaaagauguguucuuuaugcccccagagaagugugacacacuucugugcgauaucggggaaaguagccccaauccuacuauugaggagggacgaacccuaagaguccucaagaugguggaaccguggcugagggguaaccaguucuguaucaaaauauugaaucccuacaugccaucugucguggaggcgcuggaacaaaugcagcggaagcacggcgggaugcucguucgcaacccucuuuccagaaauucaacacacgagauguauuggguaagcugcggaacuggcaacaucgugucggcugucaacaugaccucuaggaugcuguuaaaucgauuuacaauggcacaucggaaacccaccuacgagcgugacguggaucugggugccgggacuagacacguugcuguggaaccugaggucgccaacuuggacauuaucggacagcgcauugaaaauaucaagaacgagcauaaaaguacguggcacuaugaugaagacaauccauacaagacaugggcauaucacggcuccuacgaggugaagcccagcggcucagccuccucuaugguaaacggggugguuaggcuccugaccaaaccuugggaugucauuccaauggugacucaaaucgcuaugaccgacacaacgcccuucggacagcagcggguguuuaaggagaaagucgacaccagaacuccgcgcgcgaagagggguacaacccagauaauggaaguuacugccaaauggcuauggggcuuccuuagccgaaauaagaagccucggauuuguacaagagaggaauuuaccaggaaagugcgcaguaacgcagcuaucggggccguauucguggaugagaaucaauggaacuccgcaaaggaagccgucgaggacgagcguuuuugggaucuggugcaucgggaaagagagcuccacaaacagggaaagugcgcuacaugcguuuauaauaugaugggcaaaagggaaaagaagcugggugaguucgggaaagccaagggaagccgcgcgaucugguacaugugguugggcgcacgauuccuggaauuugaggcccucggcuucaugaacgaggaccauugguuuucucgggaaaauucacuuagugggguggagggagaaggucugcacaaauuaggcuacauucugagagauauauccaagaucccagggggaaacauguaugcugacgauacugccggcugggacaccaggauuacggaggaugacuugcagaaugaggcaaaaaucaccgaaauuauggagcccgaacaugcucuccuggccacaagcaucuucaagcuaacuuaccagaacaaagucgugcgcguacaaagaccugcuaagaacgguaccguuauggaugugauaucucggagggaccagcgugggucgggacaggucggcacauauggccuuaauacuuuuaccaacauggaggugcagcugauccgacaaauggaaucagaggggauuuuccucccaagcgagcuggaaacgcccaauuuggccgagcgcguguuagauuggcuggaaaagcacggagcagagagacucaaacggauggcgaucuccggugacgacugugucguuaagccgauugaugacagguuugccacagcucuuaccgcccugaacgauaugggcaaagugcgcaaggacaucccucagugggaacccaguaaaggguggaaugauuggcagcagguaccauucugcucucaccauuuucaccaacuaauaaugaaggacggaagagagauuguggucccuugucggaaccaggaugagcuggugggcagggcacgaguuagccagggugcuggguggucccuccgugaaacugccugcuugggaaagucauacgcacaaauguggcagcugauguauuuccauagacgcgaccuucggcuggccgcgaaugcuaucuguagugccgugcccgucgauugggugccaacaucuaggaccacuuggagcauccacgcacaccaucaguggaugaccacagaggacaugcucuccguauggaacagaguuuggauugaagagaaucccuggauggaagauaaaacacaggugucaagcugggaggaggucccuuacuuaggcaagcgcgaagaccaauggugcggcucucugauaggguugaccgcccgggcuacuugggccacaaacauccagguggcaauuaaucagguuaggcgacugaucggaaacgagaauuaucucgacuacaugaccuccaugaaaagauuuaagaacgaaagugauccagagggugcucuuugguga

SEQ ID NO: 13330 - RNA, 9879 nt, Artificial Sequence
  derived and/or modified CDS sequence (opt3) from DENV-1__KF955442__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgacggcaccacggugguagucgaugaacacugcgggaaucgaggacccucuuuaagaacuaccacagugaccggcaagaucauucaugagugguguugcagguccuguacucucccuccacugcgcuuccggggugaagacgggugcugguacggaauggagaucagacccgugaaagagaaggaagagaaccuugucaggaguaugguuagcgccggcucuggugaaguggacuccuuuucacugggcauauugugugcuaguauuaugaucgaggaaguaaugcgcagccgauggucgcggaagaugcucaugacagggacccuggccguguuccuacugcucaucaugggacaacugacauggaaugaucuuauucguuugugcaucauggucggcgcaaacgcuuccgacagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgagcugccaaacaguuuagaagagcucggggauggacuggcgaugggcauaaugaugcuuaagcuguugacugaauuccagccccaccagcucuggaccacacugcuaucccugacuuuuaucaaaaccacgcuuucucucgacuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgagaauaagauuuggggaaggaaaucuuggccccucaacgaagguaucauggccauaggcaucguguccauucugcuaagcucgcugcuuaagaaugaugucccucucgccgggccccugaucgcuggaggcauguugauugcauguuauguaaucucagguucuagugccgacuuaucccuggagaaagcggcugaggugagcugggaacaagaggccgaacauucugggacgagccacaacauacucguugaggugcaggaugacggaacuaugaagauuaaagaugaagagcgagacgauacccugacaauccuucugaaggcaaccuugcuagccgucuccggcguguacccaaugucaaucccugcuacacuguuuguaugguauuucuggcagaaaaagaagcagcgcaguggcgugcucugggacacucccagcccaccggaggucgaacgggcaguucuggaugacgggauuuacagaauacuucaaaggggauuacugggucguucucaggugggcgugggggucuuccaggacggaguguuucauaccauguggcacguuacgcgcggcgccguacucauguaucaggguaaacgguuggagccuuccugggcgucagugaagaaagaucugaucaguuacgggggaggcuggagauuccaaggcagcuggaauacaggggaagagguccaggugauugcuguugagcccggaaagaacccaaaaaaugugcagacuacccccgguacauuuaagaccccugaaggcgaggucggggccaucgcacucgacuucaagccaggaacuuccggcucucccauugugaacagggaagguaaaaucguagggcuguacggaaauggcgucgugaccacaucgggcacguauguuagcgccauagcucaagccaaggcaucacaggaggggccucuuccggaaaucgaggaugagguguuuaaaaagcgaaaccugacuauuauggacuugcacccaggauccgguaaaacccggcgcuaccuacccgcuaucgucagagaagccauuaagaggaagcugcggacacucaucuuagcgccuacccgagugguugccagugagauggcagaagcucugaaaggcaugccaauaagauaucagacuacagccgugaagucugagcauaccgggcgcgaaauugucgaucuuaugugccacgcuacguucacuaugaggcugcucagccccgugcguguaccuaauuacaacaugaucaucauggacgaggcacauuuuacagauccggccuccauugccgcucggggauauaucucaaccagagugggcaugggugaggcggcagccauauucaugaccgcuacucccccagggucuguugaagccuuuccucagagcaaugcagucauucaagacgaggaaagggauauccccgagcgcaguuggaacuccggauacgacuggauuacagauuucccaggcaaaaccgugugguuugugccuagcaucaagucuggcaaugacauagccaacuguuugcgaaaaaacgggaagagagucauucagcugucacggaagacauucgacacugaauaucagaaaacgaagaauaacgauugggacuacguagugaccacagauaucuccgagaugggagcuaauuucagggcggaccgcguuaucgauccccguagaugccucaaaccagugauucugaaggacgguccggagcgggucauccuugccggcccuaugcccgugacuguugcaagugcugcccagaggcgcgggcgaauuggaagaaaccaaaauaaagaaggcgaucaguacguguauaugggucagccacuaaacaaugacgaggaucacgcacauuggaccgaagccaagaugcuguuggacaacauaaauacacccgaggggaucauuccugcuuuauuugagccagaacgggagaagagcgccgcgaucgauggcgaauacaggcugcgcggagaggcaagaaaaaccuucgucgaacucaugaggcggggcgaccugcccguguggcuuucguauaagguagccucugagggguuucaguacuccgaucgucgcuggugcuucgacggagagcgaaacaaucaagugcuggaagagaacauggacguugaaaucuggacuaaagagggugaaagaaagaaacucaggccucggugguuggaugcucgcacguauagcgacccgcuggcccuaagagaguuuaaggaguucgcugcaggcaggcggucagucaguggggaucugauucucgaaauaggaaaacuuccacagcaccugaccuuacgagcccagaaugcuuuggacaaccuggugaugcuccacaauucugagcagggcgguaaggccuacagacaugcaauggaagagcugcccgauacaaucgaaacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaguuuuuccucaugguacugcuuauccccgaaccagaccgccaaaggacaccucaggauaaccagcucgcauauguggucauuggucuguuguuuaugauccugacgguggccgcuaacgagaugggcuuacuagaaaccacuaagaaagaccuggggauuggacauguugcggccgagaaucaccaacacgcaacaaugcucgauguggaccuucggcccgcuucugccuggacccuguacgccgucgcaaccacaguaaucacuccaaugaugcgucauacgauagagaacaccacagcuaauauuagcuugacugccaucgcgaaccaggcugccauucugaugggccucgauaaggguuggccuaucuccaaaauggacauaggggugccgcugcuugcauuaggcugcuacucacagguuaauccccugacccucacagccgcuguguugaugcuggucgcacacuaugccaucauuggaccaggccuacaggcgaaggcuaccagagaagcccaaaagaggacugcagccgggaucaugaaaaacccuacgguggauggaauugucgcuaucgaccuggaccccgugguuuacgaugccaaguucgagaaacagcucggccagauaaugcuucugauuuuguguacaucucagauccugcucaugcgcaccacuugggcacugugcgaaaguaucaccuuagcuacagguccacuuacuacccugugggaggggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgaaacucugggugagaaguggaagaggcagcucaaucagcuuagcaaauccgaguuuaacacauacaagcgcagugggauaauggaaguagaccggucugaggcaaaagaaggacugaagagaggcgagaccacuaaacaugcugugagccgugguacagccaaguugaggugguucgucgaacggaaucugguuaagcccgagggcaaagugauugaucucggguguggacgcggcggguggucauauuacugcgccggauuaaagaaagucaccgaggugaagggcuauacgaaaggugggccgggacacgaagagccaaucccuauggcgaccuacggcuggaaccugguaaagcuucauuccggcaaagacguguuuuucaugcccccagaaaagugugauacacugcuaugcgacauuggggagaguagccccaauccuacuaucgaagagggacgaacccucagaguucugaagaugguggagccgugguugagggguaaccaguuuuguauaaaaauccugaaucccuacaugccaucugucguggaaacacucgagcaaaugcagcggaagcacggcgggaugcuuguccgcaacccucuguccagaaauucaacucacgaaauguauugggugagcugcggaaccggcaacauuguuucggcuguaaacaugacaucuaggauguuacugaaucgauucaccauggcacaucggaaacccacuuuugagcgugauguggacuugggugccgggacgagacacgucgcuguggagccugaaguugccaaccucgauaucauuggacagcgcaucgagaauauuaagaacgaacauaaaaguacauggcacuacgacgaggauaauccauauaagaccugggcauaccacggcuccuaugaagugaagcccagcggcucagccuccucuauggucaacggggugguaaggcugcuaacuaaaccuugggacgugaucccaaugguuacccaaauagcuaugacagacacgacccccuucggacagcagcgggucuuuaaggagaaaguggauacuagaacaccgcgcgcgaagagggguaccacucagauuauggaggugacagccaaauggcuuuggggcuuccugagccgaaauaagaagccucggaucuguaccagagaagaguuuacaaggaaaguccgcaguaacgcagcuaucggggccguuuucguggacgaaaaucaauggaacuccgcaaaggaggccguagaagaugagcguuuuugggaccucgugcaucgggagagagaacugcacaaacagggaaagugcgcuacuugcgucuacaauaugaugggcaaaagggagaagaaguugggugaauucgggaaagccaagggaagccgcgcgauuugguauauguggcugggcgcacgauuccucgaguuugaagcccuuggcuucaugaacgaggaucauugguuuucucgggagaauucacugagugggguggaaggagaggguuuacacaaacugggcuacauauugagagacaucuccaagauuccagggggaaacauguacgcugaugacaccgccggcugggauacgaggaucaccgaagacgaucuccagaaugaggcaaaaauuacagacaucauggagcccgaacaugcucugcuagccacuagcauauucaagcuuaccuaucagaacaaaguugugcgcguccaaagaccugcuaagaacgguacagugauggauguaaucucucggagggaccagcgugggucgggacagguuggcacuuacggccugaauaccuuuacgaacauggaggugcagcucauucgacaaauggaaucagaggggaucuuccugccaagcgaauuggagacacccaauuuagccgagcgcguccuggacuggcucgaaaagcacggagcagagagacuuaaacggauggcgauuuccggugaugacuguguggugaagccgaucgaugacagguuugccaccgcucugacugcccuaaacgauaugggcaaaguccgcaaggacauaccucagugggaacccaguaaaggguggaaugauuggcagcagguuccauucugcucucaccauuuucaccaacugauuaugaaggacggaagagagaucgugguaccuugucggaaccaggaugaacucgugggcagggcacgagucagccagggugcugggugguccuugcgugagacagccugccugggaaagucauaugcacaaauguggcagcuuauguacuuccauagacgcgaccugcggcucgccgcgaaugcuaucuguagugccgugcccguugauugggugccaaccucuaggacuaccuggagcauucacgcacaccaucaguggaugacaacggaggacauguuauccgucuggaacagaguguggauagaagagaaucccuggauggaagacaaaacccacguaucaagcugggaggaaguuccuuaucugggcaagcgcgaggaucaguggugcggcucuuugaucgggcugacugcccgggcuacaugggccaccaacauucaaguggcaaucaaucaggucaggcgacucauuggaaacgagaauuaccuugacuauaugacuuccaugaaaagauuuaagaacgaaagugauccagagggugcucugugguga

SEQ ID NO: 13331 - RNA, 9879 nt, Artificial Sequence
  derived and/or modified CDS sequence (opt3) from DENV-1__GU131965__SS-prME
agcgugaccaugcugcucaugcuucugccaacagcauuggcuuuccacuuaacuacgagaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuuggguucugaggcacccuggauucaccgugauugcucuguuucucgcacaugccaucggcacaucgauuacccaaaagggcaucauauucaucuuacugaugcuugucacgccaucaauggcuaugcggugcguggggauuggaaaccgcgauuuuguugaggguuugagcggcgccacuuggguugacgugguccuggagcacgggaguugugugacaaccauggcgaagaauaaacccacucuagauaucgaacuccugaagacagaggugaccaacccugcaauucuuagaaaacugugcaucgaagccaagauauccaauacgaccacagacucuagguguccaacucagggagaggcuaccuuggucgaagaacaggaugccaacuucguuugccggcgcacauuuguggaccgaggcugggguaauggguguggacucuucggcaaaggcagccuguuaacuugcgcaaaguuuaagugcguaaccaaacuggaggggaagauugugcaguacgaaaaccucaaauauuccgucaucgugacaguucacaccggagaucaacaucagguggguaaugagacuacggaacacggcacaauugcuaccaucacuccccaggccccuaccucagagauccagcuuacagacuacggggcgcugaccuuggacuguaguccaagaacuggacuagauuucaacgaaaugguccugcucacaaugaaggagaaaagcuggcuggugcauaagcaaugguuucuugaccugccguugcccuggacgucuggcgccuccaccucacaggagacuuggaauaggcaggaucuccugguaacauucaaaaccgcacacgcuaagaagcaagaaguuguggucuuagguagccaggagggggccaugcacacagcucugacuggcgccaccgaaauucagacgaguggaaccacaacuauauuugcaggccaucuaaaaugccggcucaagauggacaaacugacccuuaaggggacaucuuaugugauguguacuggauccuucaaauuggagaaggaagucgccgagacccagcacgguacggugcugguucaagugaaguacgagggcacagaugcuccuugcaaaaucccauucagcacccaggacgaaaaggggguaacucagaacggacgucucauuacagcgaaucccaucgucaccgauaaagagaagccugugaacauagaaacugagccacccuuuggcgagucguauauuguugugggugcaggggaaaaagcccugaaacuuucuugguucaagaaaggcuccucaaucggaaagauguuugaggcuaccgcccgcggcgcaagaaggauggccauccugggggacacagcuugggauuucggaaguauugguggcgucuuuacgagcguggggaaauugguacaucagguguucggaaccgccuacggcguucucuuuuccggugucucuuggacuaugaagaucgggauuggcauacuguuaacauggcugggacuaaauagccggaacaccucacucaguaugacauguaucgcagugggcauggugacucuguaccuuggggucaugguucaagcggacuccggaugcgugauuaacuggaaaggccgagaauugaagugugguagcgggaucuucgugaccaaugagguacacacguggacagaacaguauaaguuucaggcugauucuccgaaacgccugucagccgcaaucggaaaggccugggaggagggcgucugcgguauuagaagugcuaccaggcucgaaaacauaauguggaaacagaucagcaaugagcugaaccauauuuuacuggaaaaugacaugaaguucacugugguugugggcgacgccaacgggauccuugcacaaggcaagaagaugauucggccucagcccauggagcacaaauacuccuggaagucuuggggcaaggcuaaaaucauaggggccgauauccagaauaccacauuuauuaucgacggaccagauacuccugaaugucccgacaaccagcgcgcguggaauauuugggaggucgaggauuauggcuucgguaucuuuaccacaaacauaugguugaagcucagagacucguacacgcaaaugugcgaucacaggcugaugagcgccgcuauuaaagacuccaaggcagugcaugccgauaugggguauuggaucgaaucagagaaaaaugaaaccuggaagcuagcucgugccaguuucauugagguuaagacuuguacauggccaaaaucucacacccuguggagcaacggagugcucgaauccgagaugaucauacccaagaucuacggcgguccuauuucacagcauaauuaucggccaggcuacuucacucagacagcagggccguggcaccugggaaaacuugaguuggacuuugaucugugcgaaggcaccacgguagucguggacgagcacugcgggaaccgaggacccagcuuaagaacuaccacagcgaccggcaagaucauucaugaaugguguugcaggucuuguacucucccuccacugcgcuuccggggugaggaugggugcugguacggaauggagaucagacccgugaaagaaaaggaggaaaaucuugucagguccaugguuagugccggcagcggugagguggacucuuuuucccugggcauauugugugcuucaauuaugaucgaagagguaaugcgcagucgauggagccggaagaugcucaugacagggacccuggccguguuccuacugcucgucaugggacaacugacauggaacgaccuuauccguuugugcauuauggugggcgcaaacgcuucggauagaauggggaugggaacuaccuaucuggccuuaauggcaacguuuaaaaugaggccuauguucgccguuggccuccuguuucgccggcuuacauccagagaggugcugcuacucaccaucggucugucuuuggucgcuagcguggaacugccaaauucauuagaggaacucggggacggacuggcgaugggcauuaugaugcuuaagcuguugacugaguuccagccccaccagcucuggaccacacugcuaagucugacuuuuauaaaaaccacgcuuucccucgauuacgccuggaagacaaccgcaauggcucugucuaucguuagcuuguucccgcuguguuuauccacuacaucacagaaaaccacuuggcucccugugcugcuuggcagcuuugggugcaagccacugacaauguucuugauuaccgaaaacaagaucuggggaaggaaaaguuggccccucaaugaggguauuauggccaucggcauagucucuauccugcuauccagccugcuuaagaacgacguaccucucgccgggccccugauugcuggaggcauguugaucgcauguuaugugauuucggguucaucugccgauuuaagucuggagaaagcggcugaaguuuccugggagcaagaagccgagcauagcgggacgucucacaauauccucguggaaguccaggacgauggaacuaugaagauaaaagacgaggagcgagaugacacccugacaauucuucugaaggcaaccuugcuagccgugagcggcguauacccaauguccaucccugcuacacuguuugugugguauuucuggcagaaaaagaagcagcgcucaggcguccucugggauacucccaguccaccggaaguugagcgggcagugcuggacgaugggaucuacaggauucuucaacgaggauuacugggucguagccaggugggcgucgggguguuccaggacggaguuuuucauaccauguggcacguaacgcgcggcgccgugcucauguaucaggguaaacgguuggaaccuucuugggcguccgucaagaaagaccugauaucauacgggggaggcuggagauuccaaggcaguuggaacacaggggaggaggugcagguuaucgcuguggaacccggaaagaaucccaagaacguccagacuacccccgguacauuuaagaccccugagggcgaagugggggccauugcacucgauuucaagccaggaacuagcggcucccccaucguaaauagggaggguaaaauugucgggcuguacggaaacggcgugguuaccacaucuggcacguaugugucggccaucgcucaagccaaggcaagccaggaagggccucuuccggagauagaggacgaagucuuuaaaaagcgaaaucugacuaucauggauuugcacccaggaucagguaaaacccggcgcuaccuacccgcuauugugagagaggccaucaagaggaagcugcggacacucauuuuagcgccuacccgaguuguggccuccgaaauggcagaggcucugaaaggcaugccaaucagauaucagacuacagccgucaagagugaacauaccgggcgcgagauaguggaccuuaugugccacgcuacguucacuaugaggcugcucucucccguacgugugccuaacuacaauaugauuaucauggaugaggcacauuuuacagacccggccagcaucgccgcucggggauauauuuccaccagaguuggcaugggugaagcggcagccaucuucaugaccgcuacucccccagggucagucgaggccuuuccucagucuaacgcagugauacaagaugaagagagggacauucccgaacgcagcuggaauaguggauacgauuggaucacagacuucccaggcaaaaccgugugguuugucccuuccauuaagagcggcaacgauaucgccaacuguuugagaaagaaugggaagagaguaauacagcugucucggaagacauucgacacugaguaucagaaaacgaagaacaaugacugggauuacgugguuaccacagacauuucagagaugggagcuaacuucagggcggaucgcgugaucgacccccguagaugccucaaaccagucauccugaaggaugguccggaacgggugauucuugccggcccuaugcccguuacuguggcauccgcugcccagaggcgcgggcgaaucggaagaaaucaaaacaaagagggcgaccaguacgucuauaugggucagccacuaaauaacgaugaagaccacgcacauuggaccgaggccaagaugcuguuggauaauauuaacacacccgaggggauaaucccugcuuuauuugaaccagagcgggaaaagagugccgcgauugacggcgaguacaggcugcgcggagaagcaagaaaaaccuucguggagcucaugaggcggggcgaucugcccguauggcuuagcuauaagguggccucggagggguuucaguacucugaccgucgcuggugcuucgauggagaacgaaauaaccaaguucuggaggaaaauauggacgucgagaucuggacuaaagaaggugagagaaagaaacucaggccucggugguuggacgcucgcacguauuccgauccgcuggcccuaagagaguuuaaggaguucgcugcaggcaggcggagcgugucaggggaccugauccucgagauuggaaaacuuccacagcaccugaccuuacgagcccagaacgcuuuggauaaucuggugaugcuccacaacagugaacagggcgguaaggccuacagacaugcaauggaggaacugcccgacacaauagagacucuuaugcugcucgcguugaucgccguccugaccgggggcguuacauuauuuuuccuaucuggaaagggccuggggaaaaccuccauuggacuccuuugugugacugcuagcucagcccuguuguggauggcaaguguagagccucacuggaucgcugccagcauuauccuggaauuuuuccucauggugcugcuuauacccgagccagaucgccaaaggacaccucaggacaaccagcucgcauaugucgugaucggucuguuguuuaugauucugacgguugccgcuaaugaaaugggcuuacuagagaccacuaagaaagaucuggggaucggacauguggcggccgagaaccaccaacacgcaacaaugcucgacgucgaucuucggcccgcuuccgccuggacccuguacgccguagcaaccacagugauuacuccaaugaugcgucauacgaucgaaaauaccacagcuaacauaucuuugacugccauugcgaaucaggcugccauccugaugggccucgacaaggguuggccuauuagcaaaauggauaucgggguuccgcugcuugcauuaggcugcuacucccaggugaacccccugacccucacagccgcugucuugaugcugguggcacacuaugccauaaucggaccaggccuacaggcgaaggcuaccagagaggcccaaaagaggacugcagccgggauuaugaaaaauccuacggucgacggaaucguggcuauugaucuggaccccguuguguacgacgccaaguucgaaaaacagcucggccagaucaugcuucugauauuguguacaucacagauucugcucaugcgcaccacuugggcacugugcgagucuaucaccuuagcuacagguccacuuacuacccugugggaagggaguccuggaaaguuuuggaacacaacgaucgccguaucgauggcgaauauuuuccggggcagcuaucucgccggugcaggccuagcuuucucccugaugaaaucucuagggggaggccgaagagggaccggagcccaaggcgagacucugggugagaaguggaagaggcagcucaaccagcuuucaaaaagcgaauuuaauacauacaagcgcuccgggaucauggagguggaucggagugaagcaaaagagggacugaagagaggcgaaaccacuaaacaugcugucucucgugguacagccaaguugaggugguucguugagcggaaccuggugaagcccgagggcaaagucauagaccucggguguggacgcggcggguggagcuauuacugcgccggauuaaagaaagugaccgaaguaaagggcuauacgaaaggugggccgggacacgaggaaccaauuccuauggcgaccuacggcuggaaucuggugaaacuucauucaggcaaagauguauuuuucaugcccccagagaagugugacacacugcuaugcgauaucggggaauccagucccaacccuacuauugaggagggacgaacccucagagugcugaagauggucgaaccgugguugagggguaaucaguuuuguaucaaaauacugaaccccuacaugccaagcguggucgagacacucgaacaaaugcagcggaagcacggcgggaugcuugugcgcaauccucugucuagaaacuccacucacgagauguauuggguuucaugcggaaccggcaacaucguaagcgcugugaauaugacaucgaggauguuacugaaccgauucaccauggcacaucggaaacccacuuacgagcgugacgucgauuugggugccgggacgagacacguggcuguugaaccugagguggccaaucucgacauuaucggacagcgcauugaaaacaucaagaaugagcauaaaucuacauggcacuaugaugaagacaacccauacaagaccugggcauaucacggcaguuacgaggucaagcccuccggcagcgccucauccauggugaaugggguagugaggcugcuaacuaaaccuugggauguuauuccaauggucacccaaaucgcuaugacagacacgacccccuuuggacagcagcggguguucaaggagaaaguggacacuagaacaccgcgcgcgaagagggguaccacucagauaauggaagucacagccaaauggcuuuggggcuuucugucucgaaacaagaagccucggauuuguaccagagaggaguucacaaggaaaguucgcagcaaugcagcuaucggggccguguuuguagaugagaaccaauggaauagugcaaaggaagccguggaggacgagcguuucugggaucucguccaucgggaaagagagcugcacaaacagggaaagugcgcuacuugcguguauaacaugaugggcaaaagggaaaagaaguugggugaguuugggaaagccaagggaucccgcgcgaucugguacauguggcugggcgcacgauuccucgaguucgaggcccuuggcuuuaugaaugaggaccauugguucagccgggaaaacucucugucagggguugagggagaagguuuacacaaacugggcuacauuuugagagauauaaguaagaucccagggggaaauauguaugcugacgauaccgccggcugggacacgaggauuaccgaggaugaccuccagaacgaggcaaaaaucacagaaauuauggagcccgaacaugcucugcuagccacuuccaucuuuaaacuuaccuaccagaacaaagugguccgcgugcaaagaccugcuaagaaugguacaguaauggauguuauaagccggagggaccagcgugggucuggacaggugggcacuuauggccugaacaccuucacgaauauggagguccagcucauccgacaaauggaaucggaggggauuuuucugccaucagaguuggaaacacccaacuuagccgagcgcgugcuggauuggcucgaaaagcacggagcagagagacuuaaacggauggcgaucagcggugacgacuguguggucaagccgauugaugacagguucgccaccgcucugacugcccuaaaugauaugggcaaaguucgcaaggacaucccucagugggaacccuccaaaggguggaacgauuggcaacaggugccauuuugcagucaccauuuccaccaacugauaaugaaggacggaagagagauuguagugccuugucggaaucaggaugagcucgucggcagggcacgagugucucagggugcuggguggagcuugcgugaaacagccugccugggaaaguccuacgcacaaauguggcagcuuauguauuuucauagacgcgaccugcggcucgccgcgaacgcuaucuguucagccguucccguggauugggucccaaccaguaggacuaccuggucuauccacgcacaccaucaguggaugacaacggaggacauguuaagcguguggaauagaguauggauugaagagaaccccuggauggaagauaaaacccacguuuccucaugggaggaggugccuuaccugggcaagcgcgaagaccaguggugcggcagcuugauagggcugacugcccgggcuacaugggccaccaauauccaagucgcaauuaaccaggugaggcgacucaucggaaaugagaacuaucuugacuacaugacuucuaugaaaagauucaagaaugaauccgauccagagggugcucugugguga

SEQ ID NO: 13332 - RNA, 9879 nt, Artificial Sequence
  derived and/or modified CDS sequence (opt3) from DENV-1__GU131966__SS-prME
agcgugaccaugcugcucaugcuucugccaacagcauuggcuuuccacuuaacuacgcgaggaggggaaccucauaugaucgucuccaagcaggaaaggggaaaaucucuguuauuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagaggguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacuuuggauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaaccccaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcggaaaaacgggaagagagucauucagcugucaagaaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaguucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucacuagggggaggccgaagagggaccggagcccaaggcgagacucugggugagaaguggaagaggcagcucaaucagcuuagcaaauccgaauuuaacacauaccgccggagugggauaauggagguagauagaucugaagcaaaggagggacugaaacguggcgaaaccacuaagcaugcugugagcagggguacagccaaauugcggugguucgucgagcgcaaucugguuaagcccgagggcaaggugauugaccucggguguggacgaggcggguggucauauuacugcgccggacugaaaaaggucaccgaagugaaaggcuauacgaagggugggccgggacacgaggaaccaaucccuauggcgaccuacggcuggaaccuaguaaaacuucauuccggcaaggauguguuuuucaugcccccagagaaaugugacacacugcuaugcgauauuggggaaaguagccccaauccuacuaucgaggagggaagaacccucaggguucugaagaugguggaaccgugguugcgggguaaccaguuuuguauaaagauccugaaucccuacaugccaucugucguggagacacucgaacaaaugcagcgcaaacacggcgggaugcuugucagaaacccucuguccagaaauucaacucacgagauguauugggugagcugcggaaccggcaacauuguuucggcuguaaacaugacaucucgaauguuacugaaucgguucaccauggcacaucguaagcccacuuuugagagagacguggauuugggugccgggacgcgccacgucgcuguggaaccugagguugccaaccucgacaucauuggacagaggaucgaaaauauuaaaaacgagcauaagaguacauggcacuacgaugaagacaauccauauaaaaccugggcauaccacggcuccuaugaggugaagcccagcggcucagccuccucuauggucaacggggugguacggcugcuaacuaagccuugggaugugaucccaaugguuacccaaauagcuaugacagacacgacccccuucggacagcagagagucuuuaaagagaagguggacacucgcacaccgagggcgaaacgagguaccacucagauuauggaagugacagccaaguggcuuuggggcuuccugagccggaauaaaaagccuagaaucuguaccagggaggaauuuacacgcaagguccguaguaacgcagcuaucggggccguuuucguggaugagaaucaauggaacuccgcaaaagaagccguagaggacgagcgguuuugggaucucgugcauagagaaagggagcugcacaagcagggaaaaugcgcuacuugcgucuacaauaugaugggcaagcgcgagaaaaaguugggugaguucgggaaggccaaaggaagccgagcgauuugguauauguggcugggcgcacgguuccucgaauuugaggcccuuggcuucaugaacgaggaccauugguuuucuagagaaaauucacugagugggguggagggagaagguuuacacaagcugggcuacauauugagggauaucuccaaaauuccagggggaaacauguacgcugacgauaccgccggcugggacacgcgcaucaccgaggaugaccuccagaaugaggcaaagauuacagauaucauggaacccgagcaugcucugcuagccacuagcauauucaaacuuaccuaucagaacaagguugugagaguccaacggccugcuaaaaacgguacagugauggacguaaucucuaggcgugaucagcgagggucgggacagguuggcacuuacggccugaauaccuuuacgaacauggaagugcagcucauucgccaaauggagucagaagggaucuuccugccaagcgaguuggagacacccaauuuagccgaaagaguccuggacuggcucgagaagcacggagcagaacggcuuaagaggauggcgauuuccggugacgauuguguggugaaaccgaucgacgaucgcuuugccaccgcucugacugcccuaaacgacaugggcaaggucagaaaagauauaccucagugggagcccaguaagggguggaaugacuggcagcagguuccauucugcucucaccauuuucaccaacugauuaugaaagauggacgggaaaucgugguaccuuguaggaaccaggacgagcucgugggccgagcacgugucagccagggugcugggugguccuugagagagacagccugccugggaaagucauaugcacaaauguggcagcuuauguacuuccaucgccgggaucugaggcucgccgcgaaugcuaucuguagugccgugcccguugacugggugccaaccucuagaacuaccuggagcauucacgcacaccaucaguggaugacaacggaagauauguuauccgucuggaaccgcguguggauagaggaaaaucccuggauggaggacaagacccacguaucaagcugggaagagguuccuuaucugggcaaacgggaggaccaguggugcggcucuuugaucgggcugacugccagggcuacaugggccaccaacauucaaguggcaaucaaucagguccgaagacucauuggaaacgaaaauuaccuugauuauaugacuuccaugaagcgguuuaaaaacgagagugacccagaaggugcucugugguga

SEQ ID NO: 13333 - RNA, 9879 nt, Artificial Sequence
  derived and/or modified CDS sequence (opt3) from DENV-1__GQ868501__SS-prME
agcgugaccaugcugcucaugcuucugcccacagccuuggcuuuccacuuaacuacgagaggaggggagccucauaugaucgucuccaagcaggaaagaggaaaaucucuguuauuuaagaccucagccgguguuaacaugugcacacucauugccauggaccugggagagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacuuuggauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaaaaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaaucaaauuuggggaaggaagucuuggccccucaacgaggguaucauggccauaggcaucguguccauucugcuaagcucgcugcuuaaaaaugacgucccucucgccgggccccugaucgcuggaggcauguugauugcauguuauguaaucucagguucuagugccgauuuaucccuggagaagacggcggaagugagcugggagcaggaagcugagcauucugggacuagccacaacauacucguugaagugcaggacgauggaaccaugaaaauuaaggacgaggagcgagaugacacacugaccauccuucugaaagccacauugcuagcagucuccggcguguacccaaugucaaucccugccacucuguuuguaugguauuucuggcagaagaaaaagcaacgcaguggcgugcucugggauacccccagcccaccggaagucgagcgggcuguucuggacgaugggauuuacagaauacuucagaggggauuacugggucguucucaggugggcgugggggucuuccaggacggaguguuucauacgauguggcacguuacacgcggcgcaguacucauguaucaagguaagcgguuggaaccuuccugggccucagugaaaaaggaccugaucaguuacgggggaggcuggagauuccagggcagcuggaauacuggggaggagguccaggugauugcgguugaacccggcaagaacccaaagaaugugcaaaccacacccgguaccuuuaaaacuccugagggcgaagucggggcuaucgcccucgauuucaagccaggaaccuccggcucucccauugugaacagggaggguaagaucguagggcuguacggaaauggcgucgugacaacgucgggcacuuauguuagcgcaauagcccaggcuaaagccucacaggaagggccucuuccggagaucgaggacgaaguguuuaagaaacgaaaccugaccauuauggauuugcacccaggauccgguaagacacggcgcuaccuacccgcaaucgucagagaggcuauuaaaaggaagcugcggacccucaucuuagccccuacucgagugguugcgagugaaauggccgaggcacugaagggcaugccaauaagauaucagacaaccgcugugaaaucugaacauacggggcgcgagauugucgaccuuaugugccacgccacuuucacaaugaggcugcucagccccgugcguguaccuaauuacaacaugaucaucauggaugaggcucauuuuaccgacccggcauccauugccgcccggggauauaucucaaccagagugggcaugggugaagcugcggcaauauucaugacugccacacccccagggucuguugaggcuuuuccucaaagcaaugccgucauucaggaugaagagagggacauccccgaacgcaguuggaacuccggauacgauuggauuaccgacuucccaggcaagacagugugguuugugccuagcaucaaaucuggcaaugauauagcaaacuguuugcgaaagaacgggaaaagagucauucagcugucacggaagacuuucgacacggaguaucagaagaccaaaaauaacgacugggauuacguagugacaacugacaucuccgagaugggagccaauuucagggcugaucgcguuaucgacccccguagaugccucaagccagugauucugaaagaugguccggaacgggucauccuugcgggcccuaugcccgugaccguugccagugcagcucaaaggcgcgggcgaauuggaagaaaccagaauaaggagggcgaccaguacguguauaugggucagccacuaaacaaugaugaagaccacgcccauuggacagaggcaaaaaugcuguuggauaacauaaauacccccgaggggaucauuccugccuuauuugaaccagagcgggaaaagagcgcugccaucgacggcgaguacaggcugcgcggagaagcgagaaagacuuucgucgagcucaugaggcggggcgaucugcccguguggcuuucguauaaaguagcaucugagggguuucaauacuccgaccgucgcuggugcuucgauggagaacgaaacaaucaggugcuggaggaaaacauggacguugagaucuggacgaaggaaggugagaggaaaaagcucaggccucggugguuggacgcccgcaccuauagcgauccgcuggcucuaagagaguuuaaagaguucgccgcuggcaggcggucagucaguggggaccugauucucgagauaggaaaacuuccacagcaccugacauuacgagcacagaaugccuuggauaaccuggugaugcuccacaauucugaacaaggcgguaaggcuuacagacaugccauggaggaacugcccgacacuaucgagacccuuaugcugcucgcauugauugcggugcugacagggggcgucaccuuauuuuuccuauccggaaagggccuggggaagacuagcaucggacuccuuuguguuacagccucaagugcucuguuguggauggccagcguggagccucacuggauugcagcuuccaucauacuggaauuuuuccucaugguacugcuuauccccgagccagaucgccagaggacgccucaggacaaccaacucgccuauguggucauuggucuguuguuuaugauccugaccguggcagccaacgaaaugggcuuacuagagacuaccaaaaaggaucuggggauuggacauguugcugcggagaaucaccagcacgccaccaugcucgacguggaucuucggcccgcaucugcuuggacccuguacgccgucgccacaacuguaaucacgccaaugaugcgucauaccauagaaaacacaacugcaaauauuagcuugaccgcuaucgccaaccaggcggcuauucugaugggccucgacaaagguuggccuaucuccaagauggauauaggggugccgcugcuugccuuaggcugcuacucacagguuaauccccugacacucaccgcagccguguugaugcuggucgcucacuaugcaaucauuggaccaggccuacaagccaaagcgacuagagaggcucagaagaggacggccgcagggaucaugaagaacccuacaguggacggaauugucgccaucgaucuggaccccgugguuuacgacgcuaaauucgaaaagcagcucggccagauaaugcuucugauuuuguguaccucucaaauccugcucaugcgcacuaccugggcccugugcgagaguaucacauuagcaacugguccacuuaccacacugugggaagggucgccuggaaaauuuuggaauacgaccauugcugugagcauggccaacaucuuccggggcuccuaucucgcgggugccggccuagcauucucucugaugaagucacuagggggaggccgaagagggacuggagcucagggcgagacacugggugagaaauggaagaggcagcucaaucagcuuagcaaguccgaauuuaacaccuacaaacgcagugggauaauggagguagaucggucugaagccaaggagggacugaaaagaggcgaaacuacaaagcaugcagugagccgugguaccgcuaaauugaggugguucgucgagcggaaucugguuaagcccgagggcaaggugauugaccucggguguggacgcggcggguggucauauuacugcgccggacugaaaaaggucacggaagugaaaggcuauaccaagggugggccgggacacgaggaaccaauccuaauggccacauacggcuggaaccuuguagagcugcauuccggcaaagauguguuuuucaugccucccgaaaagugugacacucuacucugcgauauuggggagaguagcccaaaucccaccaucgaggaaggacgaacacugagaguuuugaaaaugguggagccuuggcugagggguaaccaauuuuguauaaagauccucaauccguacaugcccucugucguggaaacucuugagcagaugcagcggaagcacggcgggaugcugguccgcaacccauuauccagaaauucaacccacgagauguauugggugagcugcggaacaggcaacauuguuucggcgguaaacaugaccucuaggaugcuguugaaucgauucacuauggcucaucggaaaccuacguuugaacgugacguggaucucggugcagggacaagacacgucgccguggagcccgaaguugcuaaccuggacaucauuggacaacgcaucgagaauauuaagaacgaacauaaaaguaccuggcacuacgaugaggacaauccuuauaagacuugggccuaccacggcuccuaugaggugaaaccaagcggcucagcauccucuauggucaacggggugguaaggcuacuuaccaagcccugggaugugaucccuaugguuacacagauagccaugacggacaccacuccauucggacagcagcgggucuuuaaggaaaaaguggacacaagaacaccccgcgcuaagagggguacuacacaaauuauggaggugaccgcgaaauggcuguggggcuuccucagccgaaauaagaaaccgcggaucuguacaagagaagaguuuacuaggaagguccgcaguaacgccgcaaucggggcuguuuucguggaugaaaaucaguggaacuccgccaaggaggcaguagaggacgaacguuuuugggaucuggugcaucgggagagagaauugcacaaacagggaaagugcgcaaccugcgucuacaauaugaugggcaaaagggagaagaaacugggugaguucgggaaggcuaagggaagccgcgccauuugguauauguggcucggcgcgcgauuccuugaguuugaggcacugggcuucaugaacgaagaccauugguuuucucgggaaaauucauuaagugggguggaaggagagggucugcacaaauugggcuacauacucagagauaucuccaagauuccugggggaaacauguacgccgacgauacggcuggcugggacaccaggaucacagaggaugaccugcagaaugaagccaaaauuacugauaucauggagccagaacaugcacuacuugcuaccagcauauucaagcugacauaucaaaacaaaguugugcgcguccagagacccgccaagaacgguacugugauggacguaaucucucggagggaucagcgugggucgggacagguuggcaccuacggccucaauacguuuacaaacauggaggugcaacugauucgacagauggaaucagaggggaucuucuugccuagcgaguuagaaaccccaaaucuggcugagcgcguccucgacuggcuugaaaaacacggagccgagagacugaagcggauggcaauuuccggugacgauuguguggugaagcccaucgacgauagguuugcgacugcccuaacagcucugaacgacaugggcaaaguccgcaaggauauaccgcagugggaaccuaguaaaggguggaaugacuggcagcaaguucccuucugcucucaccauuuucaccagcucauuaugaaggauggaagagagaucgugguaccaugucggaaccaggacgaguuggugggcagggcccgagucagccaaggugcaggguggucccugcgugaaaccgcuugccuuggaaaaucauaugcccagauguggcagcugauguacuuccauagacgcgaucuccgguuagcagccaaugcgaucuguagugcugugccuguugacugggugcccacuucuaggaccacauggagcauucacgcccaccaucaguggaugacgaccgaggauaugcuguccgucuggaacagaguguggauagaagagaauccauggauggaagacaagacucacguaucaagcugggaggagguucccuauuugggcaagcgcgaagaccaauggugcggcucucugaucgggcucacagcacgggccaccugggcuacuaacauucagguggccaucaaucaggucaggcgacuuauuggaaacgagaauuaccuggauuauaugacauccaugaaaagauuuaagaacgaaagugacccugagggugcacuaugguga

SEQ ID NO: 13334 - RNA, 9879 nt, Artificial Sequence
  derived and/or modified CDS sequence (opt3) from DENV-1__HQ166035__SS-prME
agcgugaccaugcugcucaugcuucugcccacagcauuggcuuuccacuuaacuacgaggggaggggagccucauaugaucgucuccaagcaggaaaggggaaaaucucugcuauuuaagaccucagccgguguuaacaugugcacacucauugccauggaccugggagagcuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaggaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagaucagacuuacagacuacggggcccugaccuuggacuguaguccaaggacuggacuagauuucaacgaaauggugcugcucacaaugaaggagaaaagcuggcugguccauaagcagugguuucuugaccugccguugcccuggacgucuggcgcauccaccucacaagagacuuggaaucggcaggaucuccuggugacauucaaaaccgcucacgccaagaagcaggaaguaguuguguuagguagccaagagggggcuaugcacacagcccugacuggcgcaaccgaaauucagacgaguggaaccacaacuauauuugccggccaucuaaaaugccgucucaagauggacaaacugacccuuaaggggacaucuuaugucauguguacuggauccuucaaauuggagaaggaaguggcugagacccagcacgguacgguccuggugcagguuaaguacgagggcacagaugcgccuugcaaaaucccauucagcacccaagacgaaaagggggugacucagaacggacgccucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcaagaggcgccaggcggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccgaucaaccagucucuccaugacauguaucgcggucggcauggugacucuguaccuuggggugaugguccaggcugacagcggaugcguuauuaacuggaaaggccgcgaauugaagugugguucugggaucuucgugaccaacgaggugcacacguggacagaacaauauaaguuucaggccgauucaccgaaaagacugagugcagccaucggaaaggcuugggaggagggcguaugcgguauuaggagcgccacccggcucgaaaauauaauguggaaacagaucuccaacgagcugaaucauauuuuacuggaaaacgacaugaaguucacugucgugguuggcgacgcaaaugggauccuugcucagggcaagaagaugauucgcccucaacccauggagcacaaauacucuuggaagucguggggcaaggccaaaaucauaggggcggauauccagaacaccacauuuauuaucgacggaccagauacuccugaaugucccgacaaucagagagccuggaacauuugggagguggaggauuauggcuucgguaucuuuaccacaaauauaugguugaagcucagggacagcuacacgcagaugugcgaucaccgucugauguccgcugcaauuaaagacucaaaggccguccaugcugauaugggguauuggaucgaaagugagaaaaacgaaaccuggaagcuagcccgggcaucuuucauugaggugaagacuuguacauggccaaaaagccacacccugugguccaauggaguucucgaaucagagaugaucauacccaagaucuacggcgguccuauuagccaacauaacuaucgaccaggcuacuucacucagacagcggggccguggcaccugggaaaacuugaguuggacuuugaucugugcgaaggcaccacggugguagucgacgagcacugcgggaauagaggacccucuuuaaggacuaccacagugaccggcaagaucauucaugaaugguguugccgcuccuguacucucccuccacugcgguucagaggugaggaugggugcugguacggaauggagaucaggcccgugaaagaaaaggaggaaaaccuuguccgcaguaugguuagcgccggcucuggugagguggacuccuuuucacugggcauauuguguguaaguauuaugaucgaagaggugaugcgaagccgguggucgcguaagaugcucaugacagggacccuggcugucuuccuacugcucgugaugggacagcugacauggaaugaccuuaucagauugugcauuaugguuggcgccaacgcauccgauaggauggggaugggaacuaccuaucuggcuuuaauggccacguuuaaaaugcgcccuauguucgcagugggccuccuguuucggagacuuacaucuagggagguccugcuacucaccaucggucugagcuugguggccucaguugaacugccaaacaguuuagaggaacucggggacggacuggcuaugggcauuaugaugcuuaagcuguugacugaguuccaaccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggacgaaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaggaagcugagcauucugggacgagccacaacauccucgucgaagugcaagacgauggaacuaugaagauaaaagacgaggagcgcgaugacacccugacaauucuucugaaggccaccauguuggcaguauccggcguguacccaaugucaaucccugccacacccuuugucugguauuucuggcagaaaaagaagcagcggaucagaguucuaugggauacuccaaguccgccugaaguggagagggcugugcuggacgauggcauuuaccguauacuccagcgcgggcugcuuggacggagccaagucggugugggcguuuuccaggacgggguauuucauaccauguggcacgugacgagaggagcagucuuaauguaucagggcaaaaggcuggaacccucuugggccuccgugaagaaagaccucaucucauacggugggggauggcgauuccagggcaguuggaauacaggcgaggagguucaagugauugcggucgaaccagggaagaaccccaaaaaugugcagacuaccccuggaacauuuaagaccccagagggugaaguaggcgcuaucgccuuggauuucaagcccgggacuagcggauccccuauugucaaccgggaggagaagaucgugggccuguacgguaaugggguugugaccacaucuggaacguaugucucggcaauagcccaggcuaaggccagccaagagggcccgcucccagagaucgaagacgagguguuuaaaaagcgcaaccugacuauuauggaucuucaccccggcucagggaaaaccagaagguaccugccugcaaucguucgggaagcuauuaagcgaaaguugagaacacuaauccuggccccaacccgcguggucgcguccgagauggccgaagcacucaaaggaaugcccauaagguaucagacuacagcugugaagagugagcauaccggucgugagauuguagacuuaaugugccacgccacguucacuaugcggcugcuuucuccugugagaguuccgaauuacaacaugaucaucauggaugaagcucauuuuacagaccccgcaagcauugccgccaggggcuauaucuccacccgcgucgggaugggagaggcugcggcaauauucaugaccgccacuccaccuggcucaguggaggcuuuuccccagucuaaugccgugauucaggaugaagaacgagacaucccagagagaagcuggaacagugguuacgauuggauuacagacuucccugggaaaaccgucugguuuguacccuccaucaagagcggaaaugauauagcaaacugucugcggaaaaacggcaagagggugauucaacucucucgcaagacauucgacacugaguaucagaaaacgaagaauaacgacugggauuacguugugaccacagacaucucagaaaugggcgccaauuuccgugcugauagagucaucgacccacggaggugcuugaaaccggugauucugaaggaugggccugagcgcguuauccucgcgggacccaugccagugacugucgccuccgcagcucagcgaagaggucggauuggcaggaaccagaauaaagaaggggaccaauacguguauaugggacagccccugaacaaugaugaggaccacgcccauuggaccgaggcaaagaugcuucuagauaacauaaauacaccugaaggcaucauuccagcccuguuugagcccgaacgcgagaagagugcugccaucgacggugaauacagauugaggggcgaagcgcggaaaaccuucguagaguuaaugcgucgcggggaucugccuguguggcucagcuauaagguugcaucggaaggauuucaguacucugaccgaagauggugcuucgauggcgagaggaacaaucagguccuggaagagaacauggacguggaaaucuggacuaaagagggggagcggaagaaacuucgcccgagauggcuggacgccaggacguauuccgauccacucgcuuugcgggaauuuaaggaguucgccgcuggacgaagaagcgugucaggugaccugauucuagaaauaggcaaacugccccaacaccucacccuucgcgcacagaaugcccuggauaacuuagucauguugcacaauagugagcaagggggaaaggcuuacaggcaugccauggaggaacugccugacacaaucgagacucucaugcugcuugcacugauugcgguucucaccggcggugugacauuguuuuuccugucugggaagggcuuaggaaaaaccuccaucggccuacuguguguaacugccagcucagcucuccuuuggauggccaguguggaaccccacuggauugcagcuagcaucauacuggaguuuuucuugaugguccugcucaucccagaaccugaucggcagcguacaccccaagacaaccagcuggccuaugugguuauugggcuucucuuuaugauccugacgguggcagccaacgagaugggauugcuggagaccacuaagaaagauuuagguauuggccaugucgcugcggaaaaucaccagcacgccacaaugcuagacguagaucugagaccagcauccgcuuggacccucuacgccguggccaccacaguuaucacuccuaugaugaggcauacgauagagaacaccacagcaaauauuucucuuacugcuaucgccaaccaagcggcuauucugaugggguuggacaagggauggccgaucagcaaaauggauauaggcgugccccugcucgcccuggguugcuacucccaggucaauccacuuaccuuaacagcagccgugcugaugcucgucgcucacuaugcaaucauugggccuggcuugcaggccaaggcgacccgcgaagcucagaagcggacugccgcaggaaucaugaaaaaccccacgguggacggcauuguugccaucgaucuggacccagugguauacgacgcuaaguucgagaaacaacuagggcagauaaugcugcucauucuuuguacaucacagauccuguugaugcgaaccacuugggcccugugcgaaucuaucacccucgcaacaggaccucugacuaccuuaugggagggcagucccgguaaguuuuggaauacaacgauugcugugucgauggccaacaucuucagagggagcuaucuugcgggagccggccuggcauucucccucaugaaaucucuagguggcgggaggcgcggaaccggcgcucagggggagacucugggagaaaaguggaagcggcaauugaaucagcugucaaaaagcgaguuuaacacauacaagagauccggcauaauggaagucgaucguagugaggccaaagaaggucucaagagaggggaaaccacuaaacaugcaguuucucggggaacagcuaaacuucgcugguucguggagcgaaaucuggucaagccggaaggcaaagugauugacuuggguuguggcagagggggauggagcuauuacugcgccggccugaagaaaguaaccgaggugaagggguauacgaaaggaggcccaggucacgaggagccuauccccauggccaccuacggguggaaccucguuaaguuacauucaggaaaagauguguuuuucaugccacccgaaaagugugacacacugcuuugcgauauuggcgaguccaguccuaauccgacuaucgaggaaggcaggacccugcggguccuaaagaugguggagcccuggcuccgcgggaaccaguuuuguauaaaaauccugaauccauacaugccuagcgucguggaagcguuggagcagaugcaaagaaagcacggagguaugcugguuaggaacccccucucucgaaauuccacacacgagauguauuggguaucaugcggcacugggaacauugugagcgcugucaacaugaccucgcggaugcuucugaaucguuucacaauggcacauagaaaaccuaccuacgaacgcgacguggauuuaggagccggcacuaggcacguugcuguggagccagaagucgccaaccuggacaucauuggucagcggaucgagaauauuaagaacgaacauaaaucuacguggcacuaugaugaggacaaucccuacaagacaugggcauaucacgggaguuacgaggugaagccuuccggaagcgccucauccaugguaaacggcgugguuagauugcucaccaaaccaugggaugucauccccauggugacucagauagcuaugaccgacacaacgccguuuggccaacagcgcguguucaaggaaaaagucgacaccaggacuccucgagcgaagcgggggacaacccagauuauggagguuacugccaaauggcuguggggauuucuaucuagaaauaagaagccaaggaucuguacacgcgaagaguucacccguaaagugcggagcaacgcagcuaucggugccguauuuguggaugaaaaucaguggaacagugcaaaggaggccgucgaggacgaaagauucugggaucuugugcauagggagcgcgaacugcacaaacaaggcaagugcgcuacaugcguuuauaauaugauggggaaacgagagaagaagcucggagaauuuggcaaagccaaggguucccgggcgauuugguacauguggcugggggcaagauucuuggaguucgaggcccugggauuuaugaacgaagaccauugguucagcagggaaaauucucucucaggcguggaaggcgaggggcuucacaaacugggauacauauuacgcgauaucaguaagauucccgguggcaacauguaugcugacgauacugccgggugggacaccagaaucacggaggaugaccugcagaaugaagcaaaaauuaccgagaucauggaaccugagcaugcuuugcucgccacauccauauuuaagcugacuuaccagaacaaagucgugcggguacagaggccagcuaagaacggaaccguuauggaugugaucagccgucgagaccaacgcggcucuggucaggucgggacauauggacuaaauacuuucaccaacauggaagugcagcuuauuagacagauggagucggagggcaucuuucugcccucagaacucgagacgccgaaucuggccgaacggguguuggauugguuagagaagcacggcgcagaaaggcugaaacgcauggcgauuagcggggacgacugugucguuaagccuaucgaugacagauucgccacagcucucaccgcccuuaacgauaugggaaaagugcggaaggacauaccccaaugggagccauccaaagguuggaaugauuggcagcagguaccuuuuugcagucaccauuuccaccagcugauuaugaaggacggcagggagaucgugguccccugucgaaaccaagaugagcuaguggggcgugcaagaguuucucagggagcuggcuggagccugcgcgagacugccugccucgguaaguccuacgcacagauguggcaauugauguauuuucaucggagggaccugagacuugccgcgaaugcuaucuguucagccgugccagucgauugggugcccacaagucgcaccacuuggucuauucacgcacaccaucaguggaugaccacagaagacaugcugagcguauggaaccggguuuggauagaggaaaauccuuggauggaggauaaaacgcacguguccucaugggaggaagucccauaccucgggaagagggaggaccaguggugcggcagcuuaaucggccugaccgcccgagcuacuugggccacaaacauucagguggcaaucaaucaaguuagacgguugauuggcaacgaaaauuaucuggacuacaugaccucuaugaaaagguucaagaacgaguccgauccggagggggcucucugguga

SEQ ID NO: 13335 - RNA, 9879 nt, Artificial Sequence
  derived and/or modified CDS sequence (opt3) from DENV-1__GQ868502__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcacgaucuucauauuacugaugcuugccacuccaucaauggcgaugcggugcguggggaucggaaaccgcgauuuugucgaggguuugagcggcgcaacauggguggacguaguucuggagcacgggaguugugugaccacuauggccaagaauaaacccacacuagauauugaacuccugaagaccgaggucacgaacccugcuauccuuagaaaacugugcauugaagccaagaucuccaauaccacaacugacucuagguguccaacccagggagaggcaacauugguggaagagcaggaugcuaacuucgugugccggcgcacuuuugucgaccgaggcugggguaauggguguggacucuucggcaaaggcagccuguuaaccugcgccaaguuuaagugcguuacaaaacuggaggggaagaccgugcaguacgaaaaccucaaauauuccguaauagugacuguccacacgggagaucaacaucagguggguaaugagacaaccgaacacggcacuauugcgaccaucacaccccaggccccuaccucagagauucagcuuacugacuacggggcacugacauuggacuguaguccaagaacgggacuagauuucaacgaaaugguucugcucaccaugaaggagaaaagcuggcuggugcauaagcaaugguuucuugaccugccguugcccuggacuucuggcgcuuccacaucacaggagaccuggaauaggcaggaucuccuggucacauucaaaacugcccacgcuaagaagcaagaagugguaguuuuagguagccaggagggggccaugcacaccgcacugacgggcgccaccgaaauccagacaaguggaacuaccacaaucuuugcuggccaucuaaaaugccggcucaagauggacaaacugacucuuaaggggaccucuuaugugauguguacgggauccuucaaauuggagaaggaagucgcggagacacagcacgguaccgugcugguccaagugaaguacgagggcacugaugcaccuugcaaaauuccauucagcacacaggacgaaaaggggguuacccagaacggacgucucauaacugccaaucccaucgugaccgauaaagagaagccuguaaacauugaaacagagccacccuuuggcgagucguauaucgucgugggugcuggggaaaaagcccugaagcuuucuugguucaagaaaggcuccucaauaggaaagauguuugaggcaacggcccgcggcgcuagaaggauggccauucugggggacaccgcaugggauuucggaaguaucgguggcguuuuuacuagcguggggaaauugguccaucagguguucggaacagcguacggcguacucuuuuccggugugucuuggaccaugaagaucgggauuggcauccuguuaacauggcugggacuaaauagccggucaacuagucucuccaugaccuguauugcuguuggcauggucacgcuguaccuuggggugauggugcaagccgacagcggaugcgucauaaacuggaaaggccgagaauugaagugugguucugggaucuucguuacaaacgaggugcacaccuggacugaacaguauaaguuucaggcagauucaccgaaacgccugagugccgcuauuggaaaggccugggaggagggcgugugcgguaucagaagcgcaaccaggcucgaaaauaucauguggaaacagauuuccaacgagcugaaucauauauuacuggaaaacgacaugaaguucacaguagucgugggcgacgcuaaugggauccuugcccaaggaaaaaagaugauucggccucagcccauggagcacaaauacucuuggaagucguggggcaaggcgaaaaucauuggggccgauauccagaacacuaccuuuauaaucgacggaccagauacaccugaaugucccgacaaucagcgcgcuuggaacauuugggagguugaggauuauggcuucgguaucuuuacgaccaauauuugguugaagcucagagacagcuacacucaaaugugcgaucacaggcugauguccgcagccaucaaagacucaaaggcugugcaugccgauaugggguauuggauagaaagugagaaaaacgaaacauggaagcuagcacgugcgucuuucauugaggucaagaccuguacuuggccaaaaagccacacacugugguccaauggagugcucgaaucagagaugaucauucccaagaucuacggcgguccuauaagccagcauaacuaucggccaggcuacuucacccagacggccgggccguggcaccugggaaaacuugaguuggacuuugaucugugcgaaggcacuaccguugugguagacgagcacugcgggaaucgaggacccucuuuaagaacaaccacugucacaggcaagaucauucaugaaugguguugcagguccuguacccucccuccacugcgcuuccggggugaggaugggugcugguacggaauggagaucagacccgugaaagaaaaggaggaaaaccuugugaggaguauggucagcgcuggcucuggugagguugacuccuuuucacugggcauuuugugugccaguaucaugauagaagaggugaugcgcagccgauggucgcggaagaugcucaugacagggacucuggcaguauuccuacugcucgugaugggacaacugaccuggaaugaccuuauucguuugugcaucauggucggcgcuaacgccuccgauagaauggggaugggaacgacauaucuggcauuaauggccaccuuuaaaaugaggccuauguucgcugugggccuccuguuucgccggcuuacuucuagagagguucugcuacucaccaucggucugagcuugguggcgucagucgaacugccaaacaguuuagaggaacucggggacggacuggccaugggcauuaugaugcuuaagcuguugacagaguuccagccccaccagcucuggacuacccugcuaucccugacguuuaucaaaacaacccuuucucucgauuacgcauggaagacuacagcuauggcccugagcauuguguccuuguucccgcuguguuuaucaaccacuagccagaaaacaaccuggcucccuguucugcuuggcaguuuugggugcaagccacugacgauguucuugauaacugaaaauaagaucuggggaaggaaaucuuggccccucaacgaggguauuauggccaucggcauuguguccauccugcuaagcucgcugcuuaagaaugacgucccucucgcugggccccugauagcaggaggcauguugaucgccuguuauguaauuucagguucuagugcggauuuaucccuggagaaagcugccgaagugagcugggagcaagaagcagagcauucugggaccagccacaacauccucguugaagugcaggacgauggaacaaugaagauuaaagacgaggagcgagaugacacccugacaauccuucugaaggccacuuugcuagcugucuccggcguguacccaaugucaauaccugcaacccuguuuguaugguauuucuggcagaaaaagaagcagcgcaguggcgugcucugggauacgcccagcccaccggaagucgagcgggccguucuggacgaugggauuuacagaauccuucaaaggggauuacugggucguucucaggugggcgugggggucuuccaggacggaguguuucauacaauguggcacguuacucgcggcgcgguacucauguaucaggguaaacgguuggaaccuuccugggcuucagugaagaaagaccugaucaguuacgggggaggcuggagauuccaaggcagcuggaauaccggggaggagguccaggugauugccguugaacccggaaagaacccaaaaaaugugcagacaacccccgguacuuuuaagaccccugagggcgaagucggggcaauagcccucgauuucaagccaggaacauccggcucucccaucgugaacagggaggguaaaauuguagggcuguacggaaauggcgucgugacgacuucgggcaccuauguuagcgcuaucgcccaagcaaaggcuucacaggaagggccucuuccggagauugaggacgaaguguuuaaaaagcgaaaccugacaaucauggauuugcacccaggauccgguaaaacccggcgcuaccuacccgccauggucagagaggcgauaaagaggaagcugcggacucucaucuuagccccuacacgagugguugcaagugaaauggcugaggcccugaaaggcaugccaauuagauaucagaccacggcugugaagucugaacauacugggcgcgagaucgucgaccuuaugugccacgcaacauucaccaugaggcugcucagccccgugcguguaccuaauuacaacaugauuaucauggaugaggcccauuuuaccgacccggccuccauagcugcgcggggauauauuucaacuagagugggcaugggugaagcagccgcuaucuucaugacagccacccccccagggucuguugaggcauuuccucagagcaaugccgucauccaagaugaagagagggacauucccgaacgcaguuggaacuccggauacgauuggaucacagacuucccaggcaaaacugugugguuugugccuagcauaaagucuggcaaugauauugcuaacuguuugcgaaaaaacgggaagagagucauccagcugucacggaagacguucgacaccgaguaucagaaaacaaagaauaacgacugggauuacguagugacuaccgacauuuccgagaugggagcgaauuucagggccgaucgcguuaucgacccccguagaugccucaaaccagugauacugaaggaugguccggaacgggucauucuugcaggcccuaugcccgugacaguugcuagugccgcacagaggcgcgggcgaaucggaagaaaccaaaauaaagagggcgaccaguacguguauaugggucagccacuaaacaaugaugaagaccacgcccauuggaccgaggcuaagaugcuguuggauaacaucaauacucccgaggggauuaucccugccuuauuugaaccagagcgggaaaagagcgcggcaauugacggcgaguacaggcugcgcggagaagccagaaaaacguucgucgagcucaugaggcggggcgaucugcccguguggcuuucguauaagguagcuucugagggguuucaguacuccgaccgucgcuggugcuucgauggagaacgaaacaaucaagugcuggaggaaaacauggacguugagauauggaccaaagaaggugagagaaagaaacucaggccucggugguuggacgcccgcacauauagcgauccgcuggcucuaagagaguuuaaggaauucgcagccggcaggcggucagucaguggggaccugauccucgagauuggaaaacuuccacagcaccugacuuuacgagcucagaaugccuuggauaaccuggugaugcuccacaauucugaacagggcgguaaggcauacagacaugcgauggaggaacugcccgacaccaucgagacacuuaugcugcucgccuugaucgcugugcugaccgggggcgucacuuuauuuuuccuauccggaaagggccuggggaaaacaagcauuggacuccuuuguguuacggccucaagugcacuguuguggauggcuagcguggagccucacuggauagccgcauccaucauucuggaauuuuuccucaugguacugcuuauccccgagccagaucgccaaaggaccccucaggacaaccagcucgccuauguggucauuggucuguuguuuaugauccugacuguggcugcgaacgaaaugggcuuacuagagacaaccaagaaagaucuggggauaggacauguugccgcagagaaucaccaacacgcuaccaugcucgacguggaucuucggcccgccucugccuggacacuguacgcagucgcuacuacgguaaucaccccaaugaugcgucauacaauugaaaacacuaccgccaauaucagcuugacagcgauugcuaaccaggccgcaauccugaugggccucgacaaggguuggccuauauccaaaauggauauuggggugccgcugcuugccuuaggcugcuacucacagguuaauccccugacccucacugcugcaguguugaugcuggucgcccacuaugcgaucauuggaccaggccuacaggcuaaggccacgagagaggcacaaaagaggacagccgcugggaucaugaaaaacccuaccguggacggaauagucgccaucgaucuggaccccgugguuuacgacgcaaaguucgaaaaacagcucggccagauuaugcuucugaucuuguguacuucucagauucugcucaugcgcaccacaugggcucugugcgagaguaucacuuuagccaccgguccacuuacaacgcugugggaagggucgccuggaaaguuuuggaauaccacuauagcggugagcauggccaacauuuuccggggcuccuaucucgcaggugcuggccuagccuucucucugaugaaaucauuggggggaggccgaagagggacaggagcacaaggcgagacccugggugagaaguggaagaggcagcucaaucagcuuagcaaauccgaauuuaacacuuacaagcgcagugggaucauggagguagaucggucugaagcuaaagagggacugaagagaggcgaaacaaccaaacaugccgugagccgugguacggccaaguugaggugguucgucgagcggaaucugguuaagcccgagggcaaagugaucgaccucggguguggacgcggcggguggucauauuacugcgcgggauuaaagaaagucaccgaagugaagggcuauacaaaaggugggccgggacacgaggaaccaauuccuauggcuacuuacggcuggaaccugguaaagcuucauuccggcaaagauguguuuuucaugcccccagagaagugugacacccugcuaugcgauaucggggaaaguagccccaauccuacaauagaggagggacgaacucucagaguucugaagaugguggaaccgugguugagggguaaccaguuuuguauuaaaauccugaaucccuacaugccaucugucguggagacccucgaacaaaugcagcggaagcacggcgggaugcuuguccgcaacccucuguccagaaauucaacacacgagauguauugggugagcugcggaaccggcaacauuguuucggcaguaaacaugacuucuaggauguuacugaaucgauucacgauggcccaucggaaacccacauacgagcgugacguggauuugggugcugggaccagacacgucgccguggaaccugagguugcaaaccucgacaucauaggacagcgcaucgaaaauauuaagaacgagcauaaaaguacuuggcacuaugaugaagacaauccauacaagaccugggccuaucacggcuccuacgaggugaagcccagcggcucagcuuccucuauggucaacggggugguaaggcugcuaacaaaaccuugggaugugaucccaaugguuacgcaaauugcgaugaccgacacuacacccuuuggacagcagcgggucuucaaggagaaaguggacaccagaacuccgcgcgccaagagggguacaacccagaucauggaagugacagcaaaauggcuuuggggcuuucugagccgaaauaagaagccucggauuuguacuagagaggaauucaccaggaaaguccgcaguaacgcugccaucggggcaguuuuuguggaugagaaucaauggaacuccgccaaggaagcuguagaggacgagcguuucugggaucucgugcaucgggaaagagagcugcacaaacagggaaagugcgccacgugcgucuauaauaugaugggcaaaagggaaaagaaguugggugaguuugggaaagcgaagggaagccgcgcaauaugguacauguggcugggcgcccgauuccucgaauucgaggcucuuggcuuuaugaacgaggaccauugguucucucgggaaaauucacugagugggguggagggagaagguuuacacaaacugggcuacauuuugagagauaucuccaagaucccagggggaaacauguaugccgacgauaccgcaggcugggacacaaggauuacugaggaugaccuccagaaugaggcuaaaauaaccgaaaucauggagcccgaacaugcccugcuagcuacaagcauuuuuaagcuuacuuaccagaacaaaguugugcgcguccaaagaccugccaagaacgguaccgugauggauguaaucucucggagggaccagcgugggucgggacagguuggcacguauggccugaauacauucaccaacauggaggugcagcucauucgacaaauggaaucagaggggaucuuucugccaagcgaguuggaaacucccaauuuagcagagcgcguccuggauuggcucgaaaagcacggagcggagagacuuaaacggauggccauauccggugacgacuguguggugaagccgaucgaugacagguucgcuacagcccugaccgcacuaaacgauaugggcaaaguccgcaaggacauuccucagugggaacccaguaaaggguggaaugauuggcagcagguuccauuuugcucucaccauuuccaccaacugaucaugaaggacggaagagagauugugguaccuugucggaaccaggaugagcucgugggcagggcucgagucagccagggugccgggugguccuugcgugaaacugcaugccugggaaagucauacgcccaaauguggcagcuuauguauuuucauagacgcgaccugcggcucgcggcuaaugccaucuguagugcagugcccguugauugggugccaaccucuaggacaacguggagcauacacgcccaccaucaguggaugaccacugaggacauguuauccgucuggaacagaguguggauugaagagaaucccuggauggaagauaaaacacacguaucaagcugggaggagguuccuuaccugggcaagcgcgaagaccaguggugcggcucuuugaucgggcugaccgcucgggccacuugggcaacaaacauccaaguggcuauuaaucaggucaggcgacucauaggaaacgagaauuaucuugacuacaugaccuccaugaaaagauucaagaacgaaagugauccagagggugcccugugguga

SEQ ID NO: 13336 - RNA, 9879 nt, Artificial Sequence
  derived and/or modified CDS sequence (opt3) from DENV-1__GQ868503__SS-prME
agcgugaccaugcugcucaugcuucugcccacagcauuggcuuuccacuuaacuacgagaggaggggagccucauaugaucgucuccaagcaggaaaggggaaaaucucuguuauuuaagaccucagccgguguuaauaugugcacccucauugccauggaccugggagagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaucgcgauuuuguggaggguuugagcggcgcgacuuggguagacguugugcuggagcacgggaguugugucacaaccauggcaaagaauaaacccacuuuggauaucgaacuccugaagacagaggugaccaacccugccauucuuagaaaacugugcaucgaagcuaagauauccaauacgaccacagacucuagguguccaacucagggagaggccaccuugguggaggaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccagaacgaaaagggggugacucagaauggacgucucauuacagcaaaccccaucguaaccgacaaagagaagccugucaauauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggauacagccugggacuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaacagccggucaaccagucucuccaugacauguaucgcggucggcauggugacucuguaccuuggggugaugguccaagcugauagcggaugcguuauuaacuggaaaggccgagaauugaagugugguucugggaucuucgugaccaaugaggugcacacguggacagaacaguauaaguuucaggccgacucaccgaaacgccugagugcagccaucggaaaggcuugggaggagggcguaugcgguauuagaagcgccaccaggcucgaaaacauaauguggaaacagaucuccaaugagcugaaccauauuuuacuggaaaaugauaugaaguucacugucgugguuggcgacgcaaacgggauccuugcucaaggcaagaaaaugauucggccucagcccauggagcacaaauacucuuggaagucguggggcaaggccaaaaucauaggggcggacauccagaauaccacauuuauuaucgauggaccagacacuccugaaugucccgauaaccagcgcgccuggaauauuugggagguggaggacuauggcuucgguaucuuuaccacaaacauaugguugaagcucagagauagcuacacgcaaaugugcgaccacaggcugauguccgcugcaauuaaagauucaaaggccguccaugcugacaugggguauuggaucgaaagugagaaaaaugaaaccuggaagcuagagcgugccucuuucauugaagugaagacuuguacauggccaaaaagccacacccugugguccaacggaguucucgagucagagaugaucauacccaagaucuacggcgguccuauuagccagcauaauuaucggccaggcuacuucacucagacagcagggccguggcaccugggaaaacuugaauuggauuuugaccugugcgagggcaccacggugguagucgaugaacacugcgggaaccgaggacccucuuuaagaacuaccacagugaccggcaagaucauucaugagugguguugcagguccuguacucucccuccacugcgcuuccggggugaggacgggugcugguacggaauggaaaucagacccgugaaagagaaggaagagaaucuugucaggaguaugguuagcgcgggcucuggugaaguggauuccuuuucacugggcauauugugugccaguauuaugaucgaggagguaaugcgcagccgauggucgcggaagaugcucaugacagggacccuggcuguguuccuacugcucaucaugggacaacugacauggaacgaccuuauucguuugugcaucauggucggcgccaacgcauccgacagaauggggaugggaacuaccuaucuggcuuuaauggccacguuuaaaaugaggccuauguucgcagugggccuccuguuucgccggcuuacaucuagagaaguucugcuacucaccauuggucugagcuugguggccucagucgagcugccaaauaguuuagaagaacucggggauggacuggcuaugggcauaaugaugcuuaagcuguugacugaguuccagccccaccagcucuggaccacacugcuaucccugacuuuuaucaaaaccacgcuuucucucgacuacgcguggaagacaaccgccauggcacugagcauuguguccuuguucccgcuguguuuaucaacuacaagccagaaaaccacuuggcucccuguucugcuuggcaguuuugggugcaagccacugacaauguucuugaucaccgagaacaagauuuggggaaggaaaucuuggccccucaaugaggguaucauggcuauaggcaucguguccauucugcuaagcucgcugcuuaagaacgaugucccucucgccgggccccugaucgccggaggcauguugauugcuuguuauguaaucucagguucuagugcagacuuaucccuggaaaaagccgcggaggugagcugggaacaagaggcugaacauucugggacgagccacaauauacucguugaggugcaggaugacggaacuaugaagauuaaagaugaggaacgagacgauacccugacaauccuucugaaggccaccuugcuagcagucuccggcguguacccaaugucaaucccugccacacuguuuguaugguauuucuggcagaaacgcaagcagcggaguggcgugcucugggacacucccagcccaccggaggucgaaagagcuguucuggaugacgggauuuacaggauacuucaacguggauuacugggucgcucucaggugggcgugggggucuuccaggauggaguguuucauaccauguggcacguuacgcggggcgcaguacucauguaucaggguaagagauuggagccuuccugggccucagugaaaaaggaccugaucaguuacgggggaggcuggagguuccaaggcagcuggaacacaggggaggaaguccaggugauugcgguugagcccggcaagaauccaaagaacgugcagacuacccccgguaucuuuaaaacaccugaaggcgaggucggggcuauugcccucgacuucaagccaggaaccuccggcucucccaucgugaaucgagaagguaagauaguagggcuguacggaaacggcgucgugacuaccucgggcacauauguuagcgcaaucgcccaagcuaaagccucacaggaggggccucuuccggagauugaagaugagguguuuaagaaacggaaucugacgaucauggacuugcacccaggauccgguaagacucgcagauaccuacccgcaauugucagggaagcuaucaaacggaagcugcgaacccucauauuagccccuacaagagugguugcgagugagauggccgaagcacugaagggcaugccaauucgcuaucagaccacugcugugaaaucugagcauacagggagggagaucgucgaucuuaugugccacgccaccuucacgaugcgucugcucagccccgugcggguaccuaacuacaauaugaucauuauggacgaagcucauuuuacugauccggcauccaucgccgccagaggauauauaucaacaagggugggcaugggugaggcugcggcaauuuucaugaccgccacacccccagggucuguugaggcuuuuccucagagcaacgccgucauccaagacgaagaacgcgauauucccgagcgaaguuggaacuccggauacgacuggaucacugauuucccaggcaagacagugugguuugugccuagcauaaaaucuggcaacgacauugcaaacuguuugagaaagaaugggaaacgggucauccagcugucaaggaagaccuucgauacagaguaucagaagacuaaaaacaaugacugggacuacguagugacgaccgauaucuccgaaaugggagccaacuuccgcgcugaccguguuauugaucccagacggugccucaagccagugauccugaaagacgguccggagagggucauucuugcgggcccuaugcccgugacaguugccagugcagcucagcgccgagggagaauaggacggaaucaaaacaaggaaggcgaucaguacguguauaugggucagccacuaaauaacgacgaggaucacgcccauuggacugaggcaaaaaugcuguuggacaauaucaacacccccgaagggauuaucccugccuuauuugagccagaaagggaaaagagcgcugccaucgauggcgaauaccgccugagaggagaggcgaggaagacauucgucgagcucaugcggcguggcgaccugcccguguggcuuucguauaaaguagcaucugaaggguuucaguacuccgaucgccgauggugcuucgacggagagagaaauaaccaagugcuggaagagaauauggauguugaaauuuggaccaaggagggugagaggaaaaagcuccggccucgcugguuggacgccagaacuuauagcgacccgcuggcucuaagggaauuuaaagaguucgccgcuggccggcgaucagucaguggggaucugauacucgaaaucggaaaacuuccacagcaccugacguuaagagcacagaacgccuuggacaaucuggugaugcuccacaacucugagcagggcgguaaggcuuaccgccaugccauggaggaacugcccgauaccauugagacacuuaugcugcucgcauugaucgcggugcugacugggggcgucaccuuauuuuuccuauccggaaagggccuggggaagacaagcauuggacuccuuuguguuaccgccucaagugcucuguuguggauggccagcguggaaccucacuggaucgcagcuuccauaauccuggaguuuuuccucaugguacugcuuauucccgaaccagacaggcaacggacuccucaggauaaccagcucgccuauguggucaucggucuguuguuuaugauucugacaguggcagccaaugagaugggcuuacuagagacgaccaaaaaggaccuggggaucggacauguugcugcggaaaaccaccaacacgccacuaugcucgauguggaccuucgucccgcaucugcuuggacacuguacgccgucgccaccaccguaauaacaccaaugaugagacauacuauugagaauacgaccgcaaacaucagcuugacagcuauugccaaucaggcggcuauccugaugggccucgauaaagguuggccuauauccaagauggacaucggggugccgcugcuugccuuaggcugcuacucacagguuaacccccugacucucaccgcagccguguugaugcuggucgcucacuaugcaauuaucggaccaggccuacaggccaaagcgacaagggaagcucaaaagcgcaccgccgcagggauuaugaagaauccuacuguggauggaaucgucgccauagaccuggaucccgugguuuacgacgcuaaauucgagaagcagcucggccagauuaugcuucugaucuuguguacgucucagauccugcucaugcggacaaccugggcccugugcgaaaguauuacuuuagcaaccgguccacuuacaacucugugggaggggucgccuggaaaauuuuggaacaccacaaucgcugugagcauggccaauauauuccgaggcuccuaucucgcgggugccggccuagcauucucucugaugaagucacuagggggaggcagaagggggacgggagcucaaggcgagacccugggugaaaaauggaagcgccagcucaaccagcuuagcaaguccgaguuuaauacuuacaaacggagugggauuauggaaguagacagaucugaggccaaggaaggacugaaacguggcgagacaaccaagcaugcagugagcagggguacugcuaaauugcggugguucgucgagcgcaaccugguuaagcccgaaggcaaggugaucgaucucggguguggacgaggcggguggucauauuacugcgccggacugaaaaaggucacagaggugaaaggcuauaccaagggugggccgggacacgaggaaccaauuccuauggccacguacggcuggaaucuaguaaaacuucauuccggcaaggacguguuuuucaugcccccagaaaaaugugauacccugcuaugcgacaucggggagaguagccccaacccuacaauagaggaaggaagaacucucaggguucugaagaugguggagccgugguugcgggguaaucaguuuuguaucaagauucugaaccccuacaugccaucugucguggaaacccucgagcaaaugcagcgcaaacacggcgggaugcuugucagaaauccucuguccaggaacucaacacacgagauguauugggugagcugcggaacuggcaacaucguuucggcgguaaauaugaccucucgaauguuacugaaccgguucacaauggcucaucguaagcccaccuuugaaagagauguggacuugggugcagggacucgccacgucgccguggagccugaaguugcuaaucucgauauuaucggacagaggauugagaacaucaaaaaugaacauaagaguacguggcacuacgacgaggauaacccauauaaaacaugggccuaccacggcuccuaugaggugaagcccagcggcucagcauccucuauggucaauggggugguacggcugcuaaccaagccuugggacgugauaccaaugguuacucaaauugccaugaccgauacaacgcccuucggacagcagagagucuuuaaagaaaagguggacacccgcacuccgagggcuaaacgagguacaacccagaucauggaggugacugcgaaguggcuuuggggcuuccugagccggaacaaaaagccuagaaucuguacaagggaagaguuuacccgcaagguccguaguaaugccgcaauuggggcuguuuucguggacgaaaaccaauggaacuccgccaaagaggcaguagaggaugaacgguuuugggaccucgugcauagagagagggaacugcacaagcagggaaaaugcgccacaugcgucuacaacaugaugggcaagcgcgagaaaaaguugggugaguucgggaaggcuaaaggaagccgagccauaugguauauguggcugggcgcgcgguuccucgaguuugaggcacuuggcuucaugaaugaagaucauugguuuucuagagagaacucacugagugggguggaaggagaggguuuacacaagcugggcuacaucuugagggacauuuccaaaaucccagggggaaauauguacgccgaugacacugcuggcugggauacccgcauuacggaggacgaucuccagaacgaagccaagaucaccgacauaauggagcccgaacaugcacugcuagcuacaagcaucuucaaacuuacuuaucagaacaagguugugagaguccaacggccugccaaaaaugguaccgugauggauguaauuucuaggcgugaccagcgagggucgggacagguuggcacauacggccugaacacuuuuaccaauauggaggugcagcucauccgccaaauggaaucagaggggauuuuccugccaagcgaguuggaaacgcccaacuuagcugagagaguccuggauuggcucgaaaagcacggagccgagcggcuuaagaggauggcaaucuccggugacgacuguguggugaaaccgauagaugaccgcuuugcgacagcccugaccgcucuaaaugauaugggcaaggucagaaaagacauuccucagugggaacccaguaagggguggaacgauuggcagcagguuccauucugcucucaccauuuucaccaacugaucaugaaagacggacgggagaucgugguaccuuguaggaaucaggaugagcucgugggccgagcccgugucagccagggugcagggugguccuugagagaaacugcuugccugggaaagucauaugcccaaauguggcagcuuauguacuuccaucgccgggaccugaggcucgcagccaacgcgauuuguagugcugugcccguugauugggugccaacaucuagaaccacuuggagcauacacgcccaccaucaguggaugaccacagaggacauguuauccgucuggaaucgcguguggaucgaagagaaccccuggauggaagauaagacgcacguaucaagcugggaggagguuccuuaucugggcaaacgggaagaccaguggugcggcucuuugauugggcugaccgcaagggccacuugggcuacaaauauccaaguggccauuaaccagguccgaagacucaucggaaaugagaacuaccuugacuauaugaccuccaugaagcgguuuaaaaaugaaagugauccagagggugcacugugguga

SEQ ID NO: 13337 - RNA, 9879 nt, Artificial Sequence
  derived and/or modified CDS sequence (opt3) from DENV-1__GQ868504__SS-prME
agcgugaccaugcugcucaugcuucugccaacagcauuggcuuuccacuuaacuacgcggggaggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuacaggauucuucaacgaggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaagaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaucgggcacguaugucagcgcaaucgcccaagcuaaggccucacaggaagggccucuuccggagauagaggacgaaguguuuaaaaagcgaaaccugacuaucauggauuugcacccaggauccgguaaaacccggcgcuaccuacccgcaauuguuagagaggcuaucaagaggaagcugcggacacucauuuuagccccuacccgaguggucgcgagugaaauggccgaggcacugaaaggcaugccaaucagauaucagacuacagcugugaagggggaacauaccggacgcgagauaguagaccuuaugugccacgccacguucacuaugaggcugcucucucccgugcguguuccuaauuacaacaugauuaucauggaugaggcucauuuuacagacccggcaagcaucgccgcccggggcuauauuuccaccagagucgguaugggggaagcugcggcaaucuucaugaccgccacucccccaggaucaguggaggcuuuuccucagucuaaugccgugauacaagaugaagagagggacauucccgaacgcagcuggaacaguggcuacgauuggaucacagacuucccaggcaaaaccgucugguuuguaccuuccauuaagagcgggaaugauaucgcaaacuguuugagaaagaacggaaagagagugauacagcugucucggaagacauucgacacugaguaucagaaaacgaagaauaacgacugggauuacguugugaccacagacauuucagagaugggugccaauuucagggcugaucgcgucaucgacccccguagaugccucaaaccagugauccugaaggauggcccggaacggguuauucuugcggggccuaugcccgugacugucgccuccgcagcucagaggcgcggacgaaucggcagaaaccaaaauaaagagggugaccaguacguguauauggggcagccacuaaacaaugaugaagaccacgcccauuggaccgaggcaaagaugcuguuggauaacauuaauacacccgagggcauaaucccugccuuauuugaaccagagcgggaaaagagugcugccauugacggagaguacaggcugcgcggcgaagcgagaaaaaccuucguagagcucaugaggagaggggaucugcccguguggcuuagcuauaagguugcaucggagggauuucaguacccugaccgucgcuggugcuucgauggugaacgaaacaaucaaguccuggaggaaaacauggacguggagaucuggacuaaagaaggcgagagaaagaaacucaggccgcggugguuggacgcccgcacguauucugauccacuggcucuaagagaguuuaaggaguucgccgcugggaggcgguccgugagcggagaccugauccucgagauuggcaaacuuccccagcaccugaccuuacgagcacagaaugccuuggauaaccuggucaugcuccacaauucagaacagggugggaaggcuuacagacaugccauggaggaacugccugacacaauagagacucuuaugcugcucgcauugaucgcgguucugaccggcggagugacauuauuuuuccuaaguggcaaggggcugggaaaaaccucuauuggucuccuuuguguaacugccuccagcgcucuguuguggauggccucaguggagccccacuggaucgcagcuaguauuauccuggaauuuuuccucaugguccugcuuauaccagagccugaucgccaaaggacaccccaggacaaccagcucgccuaugugguuaucggccuguuguuuaugauucugacgguggcagccaacgaaaugggguuacuagagaccacuaagaaagaucugggaaucggccaugucgcugcggagaaucaccaacacgccacaaugcucgacguagaucuucggccagcaagcgcuuggacccuguacgccguggccaccacaguuauuacuccuaugaugcgucauacgaucgaaaacaccacagcaaauauauccuugacugcuauugccaaccaggcggcuauccugaugggucucgacaagggguggccgauuucuaaaauggauaucggcgugccccugcuugccuuaggaugcuacagccaggucaauccacugacccucacagcagccguguugaugcuggucgcucacuaugcaauaaucggcccugggcuacaggccaaggcgaccagagaggcucaaaagaggacugccgcaggaauuaugaaaaaccccacgguggacggcaucguugccauugaucuggacccagugguauacgacgcuaaguucgaaaaacagcucggucagaucaugcuucugauauuguguacaucccagauucugcucaugcgcaccacuugggcccugugcgagucaaucaccuuagcaacagggccucuuacuacccugugggaaggaucucccggcaaguuuuggaauacaacgaucgcugugaguauggccaacauuuuccgggguucguaucucgcgggcgccgggcuagcauucagccugaugaaauccuugggaggcgggcgaagaggaaccggcgcucaaggugagacucugggggagaaguggaagaggcagcucaaucagcuuucuaaaucagaauuuaacacauacaagcgcagcggaaucauggaggucgaucgguccgaagccaaagagggccugaagagaggugaaaccacuaaacaugcaguuagucguggcacagcuaaguugaggugguucguggagcggaaucuggucaagccggaggggaaagugauagaccucggauguggccgcgggggauggucuuauuacugcgccggcuuaaagaaaguaaccgaagugaaggguuauacgaaagggggaccaggccacgaggaaccuauucccauggccaccuacggcuggaaccugguuaaacuucauagcgggaaagauguguuuuucaugccacccgagaagugugacacacugcuaugcgauaucggagaaucauccccuaauccgacuauugaggagggucgaacccucagaguccugaagaugguggaacccugguugaggggcaaccaguuuuguaucaaaauacugaauccauacaugccuagugucguggaggcgcucgaacaaaugcagcggaagcacgggggaaugcuuguucgcaacccccugagcagaaauucuacacacgagauguauuggguauccugcggcacugguaacaucgugucagcugucaacaugaccagcaggauguuacugaaucgauucacaauggcacaucggaaaccuaccuacgagcgugacguggauuugggggccggaacuagacacguugcuguggaaccagaggucgccaaccucgacauuaucggccagcgcauugaaaauaucaagaacgagcauaaaucgacguggcacuaugaugaagacaaucccuacaagacaugggcauaucacggcucuuacgaggugaagccuaguggguccgccagcucaaugguaaacggagugguuaggcugcuaaccaaaccaugggaugucauucccauggugacucaaaucgcuaugaccgacacaacgccguuuggucagcagcggguguucaaggagaaagucgacaccagaacuccucgcgcgaagaggggcacaacccagauaauggaaguuacugccaaauggcuuuggggguuucugucccgaaauaagaagccacggauuuguacaagagaggaguucaccaggaaagugcgcucuaacgcagcuaucggagccguauuuguggaugagaaucaauggaacagcgcaaaggaagccgucgaggacgagcguuucugggaucucgugcaucgggaaagagagcugcacaaacagggcaagugcgcuacaugcguuuauaauaugauggguaaaagggaaaagaaguugggggaguuuggaaaagccaagggcagucgcgcgaucugguacauguggcugggcgcacgauuccucgaguucgaggcccuuggguuuaugaacgaggaccauugguucucccgggaaaauagccugucuggaguggagggugaaggcuuacacaaacugggguacauuuugagagauauaucaaagauccccggaggcaacauguaugcugacgauacugccgguugggacaccaggauuacggaggaugaccuccagaaugaggcaaaaaucaccgaaauuauggagccugaacaugcucugcuagccacaaguaucuuuaaacuuacuuaccagaacaaagucgugcgcguacaaagaccagcuaagaacgggaccguuauggaugugauaucccggagggaccagcguggaagcggccaggucggcacauaugggcugaauacuuucaccaacauggaggugcagcucauccgacaaauggaaucugagggaauuuuucugcccucggaguuggaaacgccgaauuuagccgagcgcgugcuggauuggcucgaaaagcacggugcagagagacuuaaacggauggcgaucucaggcgacgacugugucguuaagccuauugaugacagguucgccacagcucugaccgcccuaaacgauauggggaaagugcgcaaggacaucccccagugggaaccaagcaaaggauggaaugauuggcagcagguaccuuuuugcucccaccauuuccaccaacugauaaugaaggacggcagagagauugugguccccugucggaaccaggaugagcucguggguagggcacgaguuagucagggggcuggauggucuuugcgugaaacugccugccugggcaagagcuacgcacaaauguggcagcuuauguauuuucauagacgcgaccugcggcucgccgcgaaugcuaucuguuccgccgugccagucgauugggugcccacaucaaggaccacuuggaguauccacgcacaccaucaguggaugaccacagaggacauguuaucuguauggaacagaguuuggauugaagagaauccuuggauggaagauaaaacgcacgugagcuccugggaggaggucccauaccugggcaagcgcgaagaccaguggugcgggucauugauaggacugaccgcccgggcuacuugggccacaaacauccaaguggcaauuaaucagguuaggcgacucaucgguaacgagaauuaucuugacuacaugaccagcaugaaaagauucaagaacgaaucugauccggagggcgcucugugguga

SEQ ID NO: 13338 - RNA, 9879 nt, Artificial Sequence
  derived and/or modified CDS sequence (opt3) from DENV-1__GU131967__SS-prME
agcgugaccaugcugcucaugcuucugccaacagcauuggcuuuccacuuaacuacgagaggaggggagccucauaugaucgucuccaagcaggaaaggggaaaaucucuguuguuuaagaccucagccgguguuaacaugugcacacucauugccauggaccugggcgagcuuugugaagauacuaugaccuacaaaugcccacaaauuacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaggaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaccugcgaucacaggcugauguccgcugcaauuaaagacucaaaggccguccaugcugauaugggguauuggaucgaaagugagaaaaacgaaacuuggaagcuagcccgugcaucuuucauugaggugaagacauguaccuggccaaaaagccacacucugugguccaauggaguucucgaaucagagaugaucauacccaagaucuacggcgguccuauuagccagcauaacuaucggccaggcuacuucacacagaccgcggggccguggcaccugggaaaacuugaguuggacuuugaucugugcgaaggcacgacugugguagucgacgagcacugcgggaaucgaggacccucuuuaagaaccacaaccgugacuggcaagaucauucaugaaugguguugcagguccuguacacucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugaccgggacacuggcugucuuccuacugcucgugaugggacaacugacuuggaaugaccuuauccguuugugcauuaugguuggcgccaacgcauccgauagaauggggaugggaaccacguaucuggcuuuaauggccacauuuaaaaugaggccuauguucgcagugggccuccuguuucgccggcuuaccucuagagagguccugcuacucacuaucggucugagcuugguggccucaguugaacugccaaacaguuuagaggaacucggggacggacuggcuaugggcauuaugaugcuuaagcuguugaccgaguuccagccccaccagcucuggacaacucugcuaucccugaccuuuauaaaaacgacacuuucucucgauuacgcguggaagaccacugccauggcacugagcaucguguccuuguucccgcuguguuuaucaacaaccagccagaaaacuacauggcucccuguccugcuuggcaguuuugggugcaagccacugaccauguucuugauuacggaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacuagccacaacauccucgucgaagugcaggacgauggaaccaugaagauaaaagacgaggagcgagaugacacacugaccauucuucugaaggccacauugcuagcaguauccggcguguacccaaugucaaucccugccacucuguuugucugguauuucuggcagaaaaagaagcagcgcaguggcguucucugggauacccccagcccaccggaaguggagcgggcugugcuggacgaugggaucuaccgaauacuucaaaggggauuacugggucguucucaggucggcguggggguuuuccaggacggaguauuucauacgauguggcacgugacacgcggcgcaguccucauguaucaggguaaacgguuggaaccuuccugggccucagugaagaaagaccugauaaguuacgggggaggcuggagauuccaaggcagcuggaauacuggggaggagguucaggugaucgcggucgaacccggaaagaaccccaaaaaugugcagaccacacccgguaccuuuaagacuccugagggcgaaguaggggcuauugcccucgauuucaagccaggaaccuccggcucucccaucgucaacagggaggguaaaauuguggggcuguacggaaauggcguugugacaacgucgggcacuuaugucagcgcaaucgcccaagcuaaggccucacaggaagggccucuuccggagauagaggacgaaguguuuaaaaagcgaaaccugaccaucauggauuugcacccaggauccgguaaaacacggcgcuaccuacccgcaauuguuagagaggcuaucaagaggaagcugcggacccucauuuuagccccuacucgaguggucgcgagugaaauggccgaggcacugaaaggcaugccaaucagauaucagacaaccgcugugaagucugaacauacggggcgcgagauaguagaccuuaugugccacgccacuuucacaaugaggcugcucagccccgugcguguuccuaauuacaacaugauuaucauggaugaggcucauuuuaccgacccggcauccaucgccgcccggggauauauuucaaccagagucggcaugggugaagcugcggcaaucuucaugacugccacacccccagggucuguggaggcuuuuccucagagcaaugccgugauacaagaugaagagagggacauucccgaacgcaguuggaacuccggauacgauuggaucaccgacuucccaggcaaaacagucugguuuguaccuagcauuaagucuggcaaugauaucgcaaacuguuugcggaaaaacgggaagagagugauacagcugucaagaaagacuuucgacacggaguaucagaaaaccaagaauaacgacugggauuacguugugacaacugacauuuccgagaugggagccaauuucagggcugaucgcgucaucgacccccguagaugccucaaaccagugauccugaaggaugguccggaacggguuauucuugcgggcccuaugcccgugaccgucgccagugcagcucagaggcgcgggcgaaucggaagaaaccaaaauaaagagggcgaccaguacguguauaugggucagccacuaaacaaugaugaagaccacgcccauuggacagaggcaaagaugcuguuggauaacauuaauacccccgaggggauaaucccugccuuauuugaaccagagcgggaaaagagcgcugccauugacggcgaguacaggcugcgcggagaagcgagaaaaacuuucguagagcucaugaggcggggcgaucugcccguguggcuuucguauaagguugcaucugagggguuucaguacuccgaccgucgcuggugcuucgauggagaacgaaacaaucaaguccuggaggaaaacauggacguggagaucuggacgaaagaaggugagagaaagaaacucaggccucggugguuggacgcccgcaccuauagcgauccgcuggcucuaagagaguuuaaggaguucgccgcuggcaggcggucagugaguggggaccugauccucgagauuggaaaacuuccacagcaccugacauuacgagcacagaaugccuuggauaaccuggucaugcuccacaauucugaacagggcgguaaggcuuacagacaugccauggaggaacugcccgacacuauagagacccuuaugcugcucgcauugaucgcgguucugacagggggcgugaccuuauuuuuccuauccggaaagggccuggggaaaacuagcauuggacuccuuuguguaacagccucaagugcucuguuguggauggccagcguggagccucacuggaucgcagcuuccauuauccuggaauuuuuccucaugguccugcuuauacccgagccagaucgccaaaggacgccucaggacaaccagcucgccuaugugguuaucggucuguuguuuaugauucugaccguggcagccaacgaaaugggcuuacuagagacuacaaagaaagaucuggggaucggacaugucgcugcggagaaucaccaacacgccaccaugcucgacguagaucuucggcccgcaucugcuuggacccuguacgccguggccacaacuguuauuacgccaaugaugcgucauaccaucgaaaacacaacugcaaauauuagcuugaccgcuauugccaaccaggcggcuauccugaugggccucgacaaggguuggccuauuuccaaaauggauaucggggugccgcugcuugccuuaggcugcuacucacaggucaauccccugacacucaccgcagccguguugaugcuggucgcucacuaugcaauaaucggaccaggccuacaggccaaggcgacuagagaggcucaaaagaggacggccgcagggauuaugaaaaacccuacaguggacggaaucguugccauugaucuggaccccgugguauacgacgcuaaguucgaaaaacagcucggccagaucaugcuucugauauuguguaccucucagauucugcucaugcgcacuaccugggcccugugcgagaguaucacauuagcaacugguccacuuaccacacugugggaagggucgccuggaaaguuuuggaauacgaccaucgcugugagcauggccaacauuuuccggggcuccuaucucgcgggugccggccuagcauucucucugaugaaaucacuagggggaggccgaagagggacuggagcucaaggcgagacacugggugagaaguggaagaggcagcucaaucagcuuagcaaauccgaauuuaacaccuacaagcgcagugggaucauggaggucgaucggucugaagccaaagagggacugaagagaggcgaaacuacaaaacaugcaguuagccgugguaccgcuaaguugaggugguucguggagcggaaucuggucaagcccgagggcaaagugauagaccucggguguggacgcggcggguggucauauuacugcgccggauuaaagaaaguaacggaagugaagggcuauaccaaaggugggccgggacacggcgagccaauuccucuggccacauacggcuggaaccuuguuaagcugcauuccgggaaagauguguuuuucaugcccccagaaaagugugacacucuacucugcgauaucggagagaguagccccaauccuaccauugaagagggucgaacacugagagucuugaagaugguggagccguggcugaggggcaaccaguuuuguaucaaaauacucaaucccuacaugccaucugucguggaagcgcuugagcaaaugcagcggaagcacgggggaaugcugguucgcaacccuuuauccagaaauucaacucacgaaauguauuggguaagcugcggcaccgguaacaucgugucggcugucaacaugacaucuaggaugcuguugaaucgauucaccauggcacaucggaaacccacuuacgagcgugacguggaucucggggccggaacgagacacguugcuguggagccugaagucgccaaccuggacauuaucggccagcgcauugagaauaucaagaacgaacauaaaaguacauggcacuaugaugaggacaauccauacaagaccugggcauaucacggcuccuacgaagugaagcccagcgggucagccuccucuaugguaaacggagugguuaggcuacuuacuaaaccuugggaugucauuccaauggugacccaaaucgcuaugacagacacgacccccuuuggucagcagcggguguucaaggagaaagucgacacuagaacaccgcgcgcgaagaggggcaccacucagauaauggagguuacagccaaauggcuguggggguuucucagccgaaauaagaagccucggauuuguaccagagaagaguucacaaggaaagugcgcaguaacgcagcuaucggagccguauuuguggaugaaaaucaauggaacuccgcaaaggaggccgucgaagacgagcguuucugggaucuggugcaucgggagagagaauugcacaaacagggcaagugcgcuacuugcguuuauaauaugauggguaaaagggagaagaagcugggggaauuuggaaaagccaagggcagccgcgcgaucugguacauguggcucggcgcacgauuccuugaguucgaagcccugggguuuaugaacgaggaccauugguucucucgggaaaauucauuaaguggaguggaaggugagggccugcacaaauugggguacauucucagagauauauccaagaucccaggaggcaacauguaugcugacgauaccgccgguugggacacgaggauuaccgaagaugaccugcagaaugaggcaaaaaucacagagauuauggaacccgagcaugcucuacuugccacuagcaucuuuaagcugaccuaccagaacaaagucgugcgcguacaaagaccugcuaagaacgggacaguuauggaugugauaucucggagggaccagcguggaucgggccaggucggcacuuaugggcucaauaccuucacgaacauggaagugcagcugauccgacaaauggagucagaaggaauauuuuugccaagcgaguuagagacacccaaucuggccgaacgcgugcucgauuggcuugagaagcacggugcagaaagacugaaacggauggcgaucuccggcgacgacugugucguuaagccgauugaugacagguucgccaccgcucuaacugcccugaacgauauggggaaagugcgcaaggacaucccucagugggagcccaguaaaggauggaaugauuggcagcagguaccauuuugcucucaccauuuccaccaacucauaaugaaggacggcagagaaauuguggucccuugucggaaccaggaugaguugguggguagggcacgaguuagccagggggcuggauggucccugcgugagacagccugccuuggcaagucauacgcacaaauguggcagcugauguauuuucauagacgcgaccuccgguuagccgcgaaugcuaucuguagugccgugcccgucgauugggugccaaccucuaggacuaccuggagcauccacgcacaccaucaguggaugacaacggaagacaugcuguccguauggaacagaguuuggauugaggaaaaucccuggauggaggauaaaacccacgugucaagcugggaagaggucccuuacuugggcaagcgcgaggaccaguggugcgggucucugauaggacucacugcccgggcuacaugggccaccaacauccaaguggcaauuaaucagguuaggcgacuuaucgguaacgaaaauuaucuggacuacaugacuuccaugaaaagauucaagaacgagagugauccagaaggcgcucuaugguga

SEQ ID NO: 13339 - RNA, 9879 nt, Artificial Sequence
  derived and/or modified CDS sequence (opt3) from DENV-1__GU131968__SS-prME
agcgugaccaugcugcucaugcuucugcccacagcauuggcuuuccacuuaacuacgagaggaggggagccucauaugaucgucuccaagcaggaaaggggaaaaucucuguuauuuaagaccucagccgguguuaauaugugcacacucauugccauggaccugggagagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaucgcgauuuuguggaggguuugagcggcgcgacuuggguagacguugugcuggagcacgggaguugugucacaaccauggcaaagaauaaacccacuuuggauaucgaacuccugaagacagaggugaccaacccugccauucuuagaaaacugugcaucgaagcuaagauauccaauacgaccacagacucuagguguccaacucagggagaggccaccuugguggaggaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccagaacgaaaagggggugacucagaauggacgucucauuacagcaaaccccaucguaaccgacaaagagaagccugucaauauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggauacagccugggacuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaacagccggucaaccagucucuccaugacauguaucgcggucggcauggugacucuguaccuuggggugaugguccaagcugauagcggaugcguuauuaacuggaaaggccgagaauugaagugugguucugggaucuucgugaccaaugaggugcacacguggacagaacaguauaaguuucaggccgacucaccgaaacgccugagugcagccaucggaaaggcuugggaggagggcguaugcgguauuagaagcgccaccaggcucgaaaacauaauguggaaacagaucuccaaugagcugaaccauauuuuacuggaaaaugauaugaaguucacugucgugguuggcgacgcaaacgggauccuugcucaaggcaagaaaaugauucggccucagcccauggagcacaaauacucuuggaagucguggggcaaggccaaaaucauaggggcggacauccagaauaccacauuuauuaucgauggaccagacacuccugaaugucccgauaaccagcgcgccuggaauauuugggagguggaggacuauggcuucgguaucuuuaccacaaacauaugguugaagcucagagauagcuacacgcaaaugugcgaccacaggcugauguccgcugcaauuaaagauucaaaggccguccaugcugacaugggguauuggaucgaaagugagaaaaaugaaaccuggaagcuagagcgugccucuuucauugaagugaagacuuguacauggccaaaaagccacacccugugguccaacggaguucucgagucagagaugaucauacccaagaucuacggcgguccuauuagccagcauaauuaucggccaggcuacuucacucagacagcagggccguggcaccugggaaaacuugaauuggauuuugaccugugcgagggcaccacggugguagucgaugaacacugcgggaaccgaggacccucuuuaagaacuaccacagugaccggcaagaucauucaugagugguguugcagguccuguacucucccuccacugcgcuuccggggugaggacgggugcugguacggaauggaaaucagacccgugaaagagaaggaagagaaucuugucaggaguaugguuagcgcgggcucuggugaaguggauuccuuuucacugggcauauugugugccaguauuaugaucgaggagguaaugcgcagccgauggucgcggaagaugcucaugacagggacccuggcuguguuccuacugcucaucaugggacaacugacauggaacgaccuuauucguuugugcaucauggucggcgccaacgcauccgacagaauggggaugggaacuaccuaucuggcuuuaauggccacguuuaaaaugaggccuauguucgcagugggccuccuguuucgccggcuuacaucuagagaaguucugcuacucaccauuggucugagcuugguggccucagucgagcugccaaauaguuuagaagaacucggggauggacuggcuaugggcauaaugaugcuuaagcuguugacugaguuccagccccaccagcucuggaccacacugcuaucccugacuuuuaucaaaaccacgcuuucucucgacuacgcguggaagacaaccgccauggcacugagcauuguguccuuguucccgcuguguuuaucaacuacaagccagaaaaccacuuggcucccuguucugcuuggcaguuuugggugcaagccacugacaauguucuugaucaccgagaacaagauuuggggaaggaaaucuuggccccucaaugaggguaucauggcuauaggcaucguguccauucugcuaagcucgcugcuuaagaacgaugucccucucgccgggccccugaucgccggaggcauguugauugcuuguuauguaaucucagguucuagugcagacuuaucccuggaaaaagccgcggaggugagcugggaacaagaggcugaacauucugggacgagccacaauauacucguugaggugcaggaugacggaacuaugaagauuaaagaugaggaacgagacgauacccugacaauccuucugaaggccaccuugcuagcagucuccggcguguacccaaugucaaucccugccacacuguuuguaugguauuucuggcagaaacgcaagcagcggaguggcgugcucugggacacucccagcccaccggaggucgaaagagcuguucuggaugacgggauuuacaggauacuucaacguggauuacugggucgcucucaggugggcgugggggucuuccaggauggaguguuucauaccauguggcacguuacgcggggcgcaguacucauguaucaggguaagagauuggagccuuccugggccucagugaaaaaggaccugaucaguuacgggggaggcuggagguuccaaggcagcuggaacacaggggaggaaguccaggugauugcgguugagcccggcaagaauccaaagaacgugcagacuacccccgguacauuuaaaaccccugaaggcgaggucggggcuaucgcccucgacuucaagccaggaacuuccggcucucccauugugaaucgagaagguaagaucguagggcuguacggaaacggcgucgugaccacaucgggcacguauguuagcgcaauagcccaagcuaaagccucacaggaggggccucuuccggagaucgaagaugagguguuuaagaaacggaaucugacuauuauggacuugcacccaggauccgguaagacccgcagauaccuacccgcaaucgucagggaagcuauuaaacggaagcugcgaacacucaucuuagccccuaccagagugguugcgagugagauggccgaagcacugaagggcaugccaauacgcuaucagacuacagcugugaaaucugagcauaccgggagggagauugucgaucuuaugugccacgccacguucacuaugcgucugcucagccccgugcggguaccuaacuacaauaugaucaucauggacgaagcucauuuuacagauccggcauccauugccgccagaggauauaucucaaccagggugggcaugggugaggcugcggcaauauucaugaccgccacucccccagggucuguugaggcuuuuccucagagcaacgccgucauucaagacgaagaacgcgauauccccgagcgaaguuggaacuccggauacgacuggauuacagauuucccaggcaagaccgugugguuugugccuagcaucaaaucuggcaacgacauagcaaacuguuugagaaagaaugggaaacgggucauucagcugucaaggaagacauucgauacugaguaucagaagacgaaaaacaaugacugggacuacguagugaccacagauaucuccgaaaugggagccaacuuccgcgcugaccguguuaucgaucccagacggugccucaagccagugauucugaaagacgguccggagagggucauccuugcgggcccuaugcccgugacuguugccagugcagcucagcgccgagggagaauuggacggaaucaaaacaaggaaggcgaucaguacguguauaugggucagccacuaaauaacgacgaggaucacgcccauuggaccgaggcaaaaaugcuguuggacaauauaaacacacccgaagggaucauuccugccuuauuugagccagaaagggaaaagagcgcugccaucgauggcgaauaccgccugagaggagaggcgaggaagaccuucgucgagcucaugcggcguggcgaccugcccguguggcuuucguauaaaguagcaucugaaggguuucaguacuccgaucgccgauggugcuucgacggagagagaaauaaccaagugcuggaagagaauauggauguugaaaucuggacuaaggagggugagaggaaaaagcuccggccucgcugguuggacgccagaacguauagcgacccgcuggcucuaagggaauuuaaagaguucgccgcuggccggcgaucagucaguggggaucugauucucgaaauaggaaaacuuccacagcaccugaccuuaagagcacagaacgccuuggacaaucuggugaugcuccacaacucugagcagggcgguaaggcuuaccgccaugccauggaggaacugcccgauacaaucgagacucuuaugcugcucgcauugauugcggugcugaccgggggcgucacauuauuuuuccuauccggaaagggccuggggaagaccagcaucggacuccuuuguguuacugccucaagugcucuguuguggauggccagcguggaaccucacuggauugcagcuuccaucauacuggaguuuuuccucaugguacugcuuauccccgaaccagacaggcaacggacaccucaggauaaccagcucgccuauguggucauuggucuguuguuuaugauccugacgguggcagccaaugagaugggcuuacuagagaccacuaaaaaggaccuggggauuggacauguugcugcggaaaaccaccaacacgccacaaugcucgauguggaccuucgucccgcaucugcuuggacccuguacgccgucgccaccacaguaaucacuccaaugaugagacauacgauagagaauaccacagcaaacauuagcuugacugcuaucgccaaucaggcggcuauucugaugggccucgauaaagguuggccuaucuccaagauggacauaggggugccgcugcuugccuuaggcugcuacucacagguuaacccccugacccucacagcagccguguugaugcuggucgcucacuaugcaaucauuggaccaggccuacaggccaaagcgaccagggaagcucaaaagcgcacugccgcagggaucaugaagaauccuacgguggauggaauugucgccaucgaccuggaucccgugguuuacgacgcuaaauucgagaagcagcucggccagauaaugcuucugauuuuguguacaucucagauccugcucaugcggaccacuugggcccugugcgaaaguaucaccuuagcaacagguccacuuacuacccugugggaggggucgccuggaaaauuuuggaacacaacgauugcugugagcauggccaauaucuuccgaggcuccuaucucgcgggugccggccuagcauucucucugaugaagucacuagggggaggcagaagggggaccggagcucaaggcgagacucugggugaaaaauggaagcgccagcucaaccagcuuagcaaguccgaguuuaauacauacaaacggagugggauaauggaaguagacagaucugaggccaaggaaggacugaaacguggcgagaccacuaagcaugcagugagcagggguacagcuaaauugcggugguucgucgagcgcaaccugguuaagcccgaaggcaaggugauugaucucggguguggacgaggcggguggucauauuacugcgccggacugaaaaaggucaccgaggugaaaggcuauacgaagggugggccgggacacgaggaaccaaucccuauggccaccuacggcuggaaucuaguaaaacuucauuccggcaaggacguguuuuucaugcccccagaaaaaugugauacacugcuaugcgacauuggggagaguagccccaacccuacuaucgaggaaggaagaacccucaggguucugaagaugguggagccgugguugcgggguaaucaguuuuguauaaagauccugaaccccuacaugccaucugucguggaaacacucgagcaaaugcagcgcaaacacggcgggaugcuugucagaaauccucuguccaggaacucaacucacgagauguauugggugagcugcggaaccggcaacauuguuucggcgguaaauaugacaucucgaauguuacugaaccgguucaccauggcucaucguaagcccacuuuugaaagagauguggacuugggugcagggacgcgccacgucgccguggagccugaaguugcuaaucucgauaucauuggacagaggaucgagaacauuaaaaaugaacauaagaguacauggcacuacgacgaggauaacccauauaaaaccugggccuaccacggcuccuaugaggugaagcccagcggcucagcauccucuauggucaauggggugguacggcugcuaacuaagccuugggacgugaucccaaugguuacccaaauagccaugacagauacgacccccuucggacagcagagagucuuuaaagaaaagguggacacucgcacaccgagggcuaaacgagguaccacucagauuauggaggugacagcgaaguggcuuuggggcuuccugagccggaacaaaaagccuagaaucuguaccagggaagaguuuacacgcaagguccguaguaaugccgcaaucggggcuguuuucguggacgaaaaccaauggaacuccgccaaagaggcaguagaggaugaacgguuuugggaccucgugcauagagagagggaacugcacaagcagggaaaaugcgccacuugcgucuacaacaugaugggcaagcgcgagaaaaaguugggugaguucgggaaggcuaaaggaagccgagccauuugguauauguggcugggcgcgcgguuccucgaguuugaggcacuuggcuucaugaaugaagaucauugguuuucuagagagaacucacugagugggguggaaggagaggguuuacacaagcugggcuacauauugagggacaucuccaaaauuccagggggaaauauguacgccgaugacaccgcuggcugggauacgcgcaucaccgaggacgaucuccagaacgaagccaagauuacagacaucauggagcccgaacaugcacugcuagcuacuagcauauucaaacuuaccuaucagaacaagguugugagaguccaacggccugccaaaaaugguacagugauggauguaaucucuaggcgugaccagcgagggucgggacagguuggcacuuacggccugaacaccuuuacgaauauggaggugcagcucauucgccaaauggaaucagaggggaucuuccugccaagcgaguuggaaacacccaacuuagcugagagaguccuggauuggcucgaaaagcacggagccgagcggcuuaagaggauggcaauuuccggugacgacuguguggugaaaccgaucgaugaccgcuuugcgaccgcccugacugcucuaaaugauaugggcaaggucagaaaagacauaccucagugggaacccaguaagggguggaacgauuggcagcagguuccauucugcucucaccauuuucaccaacugauuaugaaagacggacgggagaucgugguaccuuguaggaaucaggaugagcucgugggccgagcccgugucagccagggugcagggugguccuugagagaaacagcuugccugggaaagucauaugcccaaauguggcagcuuauguacuuccaucgccgggaccugaggcucgcagccaacgcgaucuguagugcugugcccguugauugggugccaaccucuagaacuaccuggagcauucacgcccaccaucaguggaugacaacggaggacauguuauccgucuggaaucgcguguggauagaagagaaccccuggauggaagauaagacccacguaucaagcugggaggagguuccuuaucugggcaaacgggaagaccaguggugcggcucuuugaucgggcugacugcaagggccacaugggcuaccaauauucaaguggccaucaaccagguccgaagacucauuggaaaugagaacuaccuugacuauaugacuuccaugaagcgguuuaaaaaugaaagugauccagagggugcacugugguga

SEQ ID NO: 13340 - RNA, 9879 nt, Artificial Sequence
  derived and/or modified CDS sequence (opt3) from DENV-1__GQ868506__SS-prME
agcgugaccaugcugcucaugcuucugccaacagccuuggcuuuccacuuaacuacgcggggaggggaaccucauaugaucgucuccaagcaggaaaggggaaaaucucugcuauuuaagaccucagcugguguuaacaugugcacacucauugccauggaccugggcgagcuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcauuuuuccuggcccaugcuaucggcacaucgauuacccaaaagggcaucauauuuauccucuuaaugcuggugacgccaucaauggccaugcggugcgucgggauuggaaaccgcgauuucguggagggucuuagcggcgcgacuuggguagacguuguguuggagcacgggaguugugucacaaccauggcaaagaauaaacccacucuggauaucgaacuacucaagacagaggugaccaacccugccauucugagaaaacuuugcaucgaagcuaagauauccaauacgaccacagacucuagguguccaacucagggagaggccacccugguggaagaacaggaugcaaacuuugucugccggcgcacauucguugaccgaggcugggguaauggguguggauuguuuggcaaaggcagccuccugacuugcgcuaaguucaagugcgugaccaaauuagaggggaagauuguacaguacgaaaaccugaaauauuccgugaucgucacagugcacaccggagaucaacaucagguugguaaugagacuacggaacacggcacaauugccaccaucacuccccaggcgccuaccucagagauccagcucacagacuacggggcccuuacccuggacuguaguccaagaacuggauuggauuuuaacgaaauggugcuacugacaaugaaggagaaaagcuggcucguccauaagcaaugguuccuggaccuuccgcugcccuggacgucuggcgcauccaccucacaggagacuuggaauaggcaggauuugcucgugacauuuaaaaccgcucacgccaagaagcaagaaguaguugugcuggguagccaggagggggcuaugcacacagccuuaacuggcgcaaccgaaauucagacgaguggaaccacaacuauauucgccggccaucugaaaugccggcuaaagauggacaaacucacccugaaggggacaucuuaugucauguguacuggauccuucaaacuugagaaggaaguggcugagacccagcacgguacggucuuggugcaaguuaaguacgagggcacagaugcgccuugcaaaaucccauuuagcacccaggacgaaaagggggugacucagaacggacgucugauuacagcaaaucccaucguaaccgauaaagagaagccugucaacauagaaacugagccacccuucggcgagucguauauugugguuggugccggggaaaaagcucucaagcugucuugguuuaagaaaggcuccucaaucggaaagauguucgaggccaccgcacgcggcgccagaaggauggcuauccuuggggacacagccugggauuuuggaaguauugguggcguguucacgagcgucgggaaacuggugcaucagguauuuggaaccgcauacggcguguuguucuccgguguuucuuggacuaugaagaucgggauuggcauacuccugacaugguuaggacugaauagccggucaaccagucuauccaugacauguaucgcggucggcauggugacucucuaccugggggugaugguccaagcugacagcggaugcguuauuaacuggaaaggccgagaacuuaagugugguucugggaucuuugugaccaacgaggugcacacguggacagaacaguauaaguuccaggccgauucaccgaaacgcuugagugcagccaucggaaaggcuugggaggagggcguaugcgguauuagaagcgccaccaggcuggaaaauauaauguggaaacagaucuccaacgagcucaaucauauucuguuagaaaacgacaugaaguuuacugucgugguuggcgacgcaaaugggauccuggcucaaggcaagaagaugauucggccucagcccauggagcacaaauacucuuggaagucguggggcaaggccaaaaucauaggggcggauauccagaacaccacauucauuaucgacggaccagauacuccugaaugucccgacaaucagcgcgccuggaacauuugggagguggaggauuauggcuuugguaucuucaccacaaauauauggcuuaaguugagagacagcuacacgcaaaugugcgaucacaggcucauguccgcugcaauuaaagacucaaaggccguccaugcugauaugggguauuggaucgaaagugagaaaaacgaaaccuggaagcuggcccgugcaucuuucauugaggugaagacuuguacauggccaaaaagccacacccuaugguccaauggaguucuggaaucagagaugaucauacccaagaucuacggcgguccuauuagccagcauaacuaucggccaggcuacuuuacucagacagcggggccguggcaccucggaaaacuggagcuugacuucgauuugugcgaaggcaccacggugguagucgacgagcacugcgggaaucgaggacccucucugagaacuaccacagugaccggcaagaucauucaugaaugguguugcagguccuguacuuuaccuccacuccgcuuucggggugaggaugggugcugguacggaauggagaucagacccgugaaagaaaaggaggaaaaccuggucaggaguaugguuagcgccggcucuggugagguggacuccuucucacuuggcauacuguguguaaguauuaugaucgaagaggugaugcgcagccgauggucgcggaagauguugaugacagggacccucgcugucuuucugcuacuggugaugggacaacucacauggaaugaccugauccgucuuugcauuaugguuggcgccaacgcauccgauagaauggggaugggaacuaccuauuuggcucugauggccacguucaaaaugaggccuauguuugcagugggcuuacucuuccgccggcugacaucuagagagguccuucugcuaaccaucggucucagccugguggccucaguugaauugccaaacagucuggaggaauuaggggacggacucgcuaugggcauuaugaugcugaaacuucugacugaguuucagccccaccaguuguggaccacacuccugucccuaacuuucauaaaaaccacgcugucucuugauuacgcguggaagacaaccgccauggcacucagcaucgugucccuguuuccguugugucugucaacuacaagccagaaaaccacuugguuaccuguccuccugggcaguuucgggugcaagccacuuacaauguuucugauuaccgaaaauaagaucuggggaaggaaaucuuggcccuugaacgaggguauuauggcuaucggcauaguauccauccuccugagcucgcuacugaagaaugacgugccucuugccgggccccucauugccggaggcaugcugaucgcuuguuauguuauuucagguucuagugcagauuuguccuuagagaaagccgcggaagugagcugggagcaagaagcugagcauucugggacgagccacaacauccuggucgaagugcaggacgauggaacuaugaagauaaaagacgaggagcgagaugacacccucacaauucugcuuaaggccacccuguuggcaguauccggcguguacccaaugucaaucccugccacacuauucgucugguauuucuggcagaaaaagaagcagcgcaguggcguucugugggauacucccagcccaccggaaguggagcgggcugugcucgacgaugggaucuacaggauucugcaacgaggacuuuuaggucguucucaggucggcguggggguuuuucaggacggaguauuccauaccauguggcacgugacgcgcggcgcaguccugauguaucaggguaaacggcucgaaccuuccugggccucagugaagaaagacuugauaaguuacgggggaggcuggagauuucaaggcagcuggaauacaggggaggagguucaggugaucgcggucgaacccggaaagaaccccaaaaaugugcagacuacccccgguacauucaagaccccugagggcgaaguaggggcuauugcccuggauuuuaagccaggaacuuccggcucucccaucgucaacagggaggguaaaauuguggggcucuacggaaauggcguugugaccacaucgggcacguaugucagcgcaaucgcccaagcuaaggccucacaggaagggccucugccggagauagaggacgaaguguucaaaaagcgaaaccuuacuaucauggaucugcacccaggauccgguaaaacccggcgcuacuugcccgcaauuguuagagaggcuaucaagaggaagcuacggacacugauucucgccccuacccgaguggucgcgagugaaauggccgaggcauuaaaaggcaugccaaucagauaucagacuacagcugugaagucugaacauaccgggcgcgagauaguagaccugaugugccacgccacguuuacuaugaggcuucugagccccggacgugugccuaauuacaacaugauuaucauggaugaggcucauuucacagacccggcauccaucgccgcccggggcuauauuucaaccagaguugguaugggggaagcugcggcaaucuuuaugaccgccacucccccaggaucugucgaggcuuucccucagagcaaugccgugauacaagaugaagagagggacauucccgaacgcaguuggaacuccggcuacgauuggaucacagacuuuccaggcaaaaccgugugguucgucccuagcauuaagucugggaaugauaucgcaaacugucucagaaagaacggaaaaagaguaauacaguugucacggaagacauucgacacugaguaucagaaaacgaagaauaacgacugggauuacgugguuaccacagacauuuccgagaugggugccaauuuuagggcugaucgcgugaucgacccccguagaugccugaaaccagucauccucaaggauggcccggaacgggugauucuggcggggccuaugcccguuacuguggccagugcagcucagaggcgcggacgaaucggcagaaaccaaaauaaagagggugaccaguacgucuauauggggcagccacuuaacaaugaugaagaccacgcccauuggaccgaggcaaagaugcuacuggauaacauuaauacacccgagggcauaaucccugccuuguucgaaccagagcgggaaaagagcgcugccauugacggagaguacagguuacgcggcgaagcgagaaaaaccuuuguggagcugaugaggagaggggaucuccccguauggcugucguauaagguggcaucugagggauuccaguacuccgaccgucgcuggugcuuugauggugaacgaaacaaucaaguucuugaggaaaacauggacgucgagaucuggacuaaagaaggcgagagaaagaaacugaggccucgguggcucgacgcccgcacguauagcgauccguuggcucugagagaguucaaggaauuugccgcugggaggcggucagugaguggagaccuaauccuggagauuggcaaacucccacagcaccuuacccugcgagcacagaaugccuuagauaacuuggugaugcugcacaauucugaacagggugggaaggcuuacagacaugccauggaggaacuccccgacacaauagagacucugaugcuucuggcacucaucgcggucuugaccggcggaguuacacuguucuuuuuauccggcaaggggcuaggaaaaaccagcauuggucugcucugugugacugccucaagugcacuucuguggauggccagcguagagccucacuggaucgcagcuuccauuaucuuggaguucuuucugauggugcuccugauacccgagccagaucgccaaaggacaccucaggacaaccagcuugccuaugucgugaucggccuccuguucaugauuuugacgguugcagccaacgaaauggggcuguuagagaccacuaagaaagaucuaggaaucggccauguggcugcggagaaucaccaacacgccacaaugcuggacgucgaucuccggcccgcaucugcuuggacccuuuacgccguagccaccacagugauuacuccaaugaugcgucauacgaucgaaaacaccacagcaaauauaagccugacugcuauugccaaccaggcggcuaucuugaugggucuggacaagggguggccuauuuccaaaauggauaucggcguuccgcuccuggcccuuggaugcuacucacaggugaaucccuuaacccugacagcagccguccucauguugguggcucacuaugcaauaaucggcccagggcugcaggccaaggcgaccagagaggcucaaaagaggacugccgcaggaauuaugaaaaacccuacggucgacggcaucguggccauugaucuagaccccguuguguacgacgcuaaguuugaaaaacagcugggucagaucaugcuccuuauacuguguacaucucagauuuugcugaugcgcaccacuugggcccucugcgagaguaucacccuggcaacagggccauuaacuacccuuugggaaggaucgccuggcaaguucuggaauacaacgaucgcuguaagcauggccaacauuuuccgggguuccuaucuggcgggcgccgggcucgcauuuucucuaaugaaaucacugggaggcgggcgaagaggaaccggcgcucaaggugagacuuugggggagaaguggaagaggcagcugaaucagcucagcaaauccgaguucaacacauacaagcgcaguggaaucauggagguggaucggucugaagccaaagagggccuuaagagaggugaaaccacuaaacaugcagucagccguggcacagcuaagcugaggugguuuguugagcggaauuuggugaagcccgaggggaaagucauagaccugggauguggccgcgggggauggucauauuacugcgccggccucaagaaagugaccgaaguaaaggguuauacgaaagggggaccgggccacgaggaaccaauuccuauggccaccuacggcuggaacuuagugaagcugcauuccgggaaagauguuuucuuuaugcccccagagaagugugacacacuucugugcgauaucggagaaaguagccccaauccuacuauugaggagggucgaacccuaagagugcucaagauggucgaaccguggcugaggggcaaccaguucuguaucaaaauauugaaucccuacaugccaucuguggucgaggcgcuggaacaaaugcagcggaagcacgggggaaugcucgugcgcaacccucuuuccagaaauucaacacacgagauguauuggguuagcugcggcacugguaacaucguaucggcugugaacaugaccucuaggaugcuguuaaaucgauuuacaauggcacaucggaaacccaccuacgagcgugacgucgaucugggggccggaacuagacacguggcuguugaaccugagguggccaacuuggacauuaucggccagcgcauugaaaauaucaagaacgagcauaaaaguacguggcacuaugaugaagacaauccauacaagacaugggcauaucacggcuccuacgaggucaagcccagcgggucagccuccucuauggugaacggaguagugaggcuccugaccaaaccuugggauguuauuccaauggucacucaaaucgcuaugaccgacacaacgcccuucggucagcagcggguguuuaaggagaaaguggacaccagaacuccgcgcgcgaagaggggcacaacccagauaauggaagucacugccaaauggcuauggggguuccuuagccgaaauaagaagccucggauuuguacaagagaggaauuuaccaggaaaguucgcaguaacgcagcuaucggagccguguucguagaugagaaucaauggaacuccgcaaaggaagccguggaggacgagcguuuuugggaucugguccaucgggaaagagagcuccacaaacagggcaagugcgcuacaugcguguauaauaugauggguaaaagggaaaagaagcugggggaguucggaaaagccaagggcagccgcgcgaucugguacaugugguugggcgcacgauuccuggaauuugaggcccucggguucaugaacgaggaccauugguuuucucgggaaaauucacuuaguggaguugagggugaaggccugcacaaauuaggguacauucugagagauauauccaagaucccaggaggcaacauguaugcugacgauacugccgguugggacaccaggauuacggaggaugacuugcagaaugaggcaaaaaucaccgaaauuauggagcccgaacaugcucuccuggccacaagcaucuucaagcuaacuuaccagaacaaagugguccgcgugcaaagaccugcuaagaacgggaccguaauggauguuauaucucggagggaccagcguggaucgggccaggugggcacauaugggcuuaauacuuuuaccaacauggagguccagcugauccgacaaauggaaucagagggaauuuuccucccaagcgagcuggaaacgcccaauuuggccgagcgcguguuagauuggcuggaaaagcacggugcagagagacucaaacggauggcgaucuccggcgacgacuguguggucaagccgauugaugacagguuugccacagcucuuaccgcccugaacgauauggggaaaguucgcaaggacaucccucagugggaacccaguaaaggauggaaugauuggcaacaggugccauucugcucucaccauuuucaccaacuaauaaugaaggacggcagagagauuguagugccuugucggaaccaggaugagcuggucgguagggcacgagugagccagggggcuggauggucccuccgugaaacugccugcuugggcaagucauacgcacaaauguggcagcugauguauuuccauagacgcgaccuucggcuggccgcgaaugcuaucuguagugccguucccguggauugggucccaacaucuaggaccacuuggagcauccacgcacaccaucaguggaugaccacagaggacaugcucuccguguggaacagaguauggauugaagagaaucccuggauggaagauaaaacgcacguuucaagcugggaggaggugccuuacuuaggcaagcgcgaagaccaguggugcgggucucugauaggauugaccgcccgggcuacuugggccacaaacauccaagucgcaauuaaucaggugaggcgacugaucgguaacgagaauuaucucgacuacaugaccuccaugaaaagauuuaagaacgaaagugauccagagggcgcucuuugguga

SEQ ID NO: 13341 - RNA, 9879 nt, Artificial Sequence
  derived and/or modified CDS sequence (opt3) from DENV-1__GQ868507__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggauaacccugcuaucccugacauuuaucaaaacuacccuuucucucgauuacgccuggaagacgacagcaauggcucugagcauuguuuccuuguucccgcuguguuuaucaaccacuagccagaaaacaaccuggcucccugugcugcuuggcaguuuugggugcaagccacugacuauguucuugaucacagaaaauaagauuuggggaaggaaaucuuggccccucaacgaggguaucauggccauaggcaucgucuccauucugcuaagcucgcugcuuaagaaugacguaccucucgccgggccccugaucgcuggaggcauguugauugcauguuaugugaucucagguucuagugccgauuuaucccuggagaaagcggcugaaguuagcugggagcaagaagccgagcauucugggaccagccacaacauacucguggaaguccaggacgauggaacgaugaagauuaaagacgaggagcgagaugacacucugaccauccuucugaaggcaacauugcuagccguguccggcguauacccaaugucaaucccugcuacccuguuugugugguauuucuggcagaaaaagaagcagcgcaguggcguccucugggauacacccagcccaccggaaguugagcgggcagugcuggacgaugggauuuacagaauacuucaaaggggauuacugggucguucucaggugggcgucgggguguuccaggacggaguuuuucauacuauguggcacguaacccgcggcgccgugcucauguaucaggguaaacgguuggaaccuuccugggcgucagucaagaaagaccugaucaguuacgggggaggcuggagauuccaaggcagcuggaauacgggggaggaggugcagguuauugcuguggaacccggaaagaacccaaaaaauguccagacaaugcccgguacuuuuaagaccccugagggcgaagugggggccaucgcacucgauuucaagccaggaacauccggcucucccauuguaaacagggaggguaaaaucgucgggcuguacggaaauggcgugguuaccacuucgggcaccuaugugagcgccauagcucaagccaaggcaucacaggaagggccucuuccggagaucgaggacgaagucuuuaaaaagcgaaaccugacaauuauggauuugcacccaggauccgguaaaacgcggcgcuaccuacccgcuauggugagagaggccaucaagaggaagcugcggacucucauuuuagcgccuacccgaguuguggccagugaaauggcagaggcucugaaaggcaugccaaucagauaucagacaaccgccgucaagucugaacauacugggcgcgagauaguggaccuuaugugccacgcuacauucaccaugaggcugcucagccccguacgugugccuaauuacaacaugauuaucauggaugaggcacauuuuacggacccggccuccaucgccgcucggggauauauuucaacuagaguuggcaugggugaagcggcagccaucuucaugacagcuacccccccagggucugucgaggccuuuccucagagcaaugcagugauacaagaugaagagagggacauucccgaacgcaguuggaacuccggauacgauuggaucaccgacuucccaggcaaaacugugugguuugucccuagcauuaagucuggcaaugauaucgccaacuguuugcgaaaaaacgggaagagaguaauacagcugucacggaagacauucgacaccgaguaucagaaaacaaagaauaacgacugggauuacgugguuacuacggacauuuccgagaugggagcuaauuucagggcggaucgcgugaucgacccccguagaugccucaaaccagucauccugaaggaugguccggaacgggugauucuugccggcccuaugcccguuaccguggcaagugcugcccagaggcgcgggcgaaucggaagaaaccaaaauaaagagggcgaccaguacgucuauaugggucagccacuaaacaaugaugaagaccacgcacauuggacagaggccaagaugcuguuggauaacauuaauacucccgaggggauaaucccugcuuuauuugaaccagagcgggaaaagagcgccgcgauugacggcgaguacaggcugcgcggagaagcaagaaaaaccuucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagaucuggacaaaagaaggugagagaaagaaacucaggccucggugguuggacgcucgcaccuauagcgauccgcuggcccuaagagaguuuaaggaauucgcugcaggcaggcggucagugaguggggaccugauccucgagauuggaaaacuuccacagcaccugacuuuacgagcccagaaugcuuuggauaaccuggugaugcuccacaauucugaacagggcgguaaggccuacagacaugcaauggaggaacugcccgacacgauagagacccuuaugcugcucgcguugaucgccguccugacagggggcguuacuuuauuuuuccuauccggaaagggccuggggaaaaccagcauuggacuccuuugugugacagcuucaagugcccuguuguggauggcaagcguagagccucacuggaucgcugccuccauuauccuggaauuuuuccucauggugcugcuuauacccgagccagaucgccaaaggaccccucaggacaaccagcucgcauaugucgugaucggucuguuguuuaugauucugacuguugccgcuaacgaaaugggcuuacuagagacaacgaagaaagaucuggggaucggacauguggcggccgagaaucaccaacacgcaaccaugcucgacgucgaucuucggcccgcuucugccuggacucuguacgccguagcaacaaccgugauuaccccaaugaugcgucauacaaucgaaaacacuacggcuaauauaagcuugaccgccauugcgaaccaggcugccauccugaugggccucgacaaggguuggccuauuuccaaaauggauaucgggguuccgcugcuugcauuaggcugcuacucacaggugaauccccugacacucacugccgcugucuugaugcugguggcacacuaugccauaaucggaccaggccuacaggcgaaggcuaccagagaggcccaaaagaggacagcagccgggauuaugaaaaacccuaccgucgacggaaucguggcuauugaucuggaccccguuguguacgacgccaaguucgaaaaacagcucggccagaucaugcuucugauauuguguacuucucagauucugcucaugcgcacgacaugggcacugugcgagaguaucaccuuagcuacugguccacuuaccacacugugggaagggucgccuggaaaguuuuggaauacuaccaucgccguaagcauggcgaacauuuuccggggcuccuaucucgccggugcaggccuagcuuucucucugaugaaaucauuggggggaggccgaagagggacaggagcccaaggcgagacgcugggugagaaguggaagaggcagcucaaucagcuuagcaaauccgaauuuaacaccuacaagcgcagugggaucauggagguggaucggucugaagcaaaagagggacugaagagaggcgaaacuacaaaacaugcugucagccgugguaccgccaaguugaggugguucguugagcggaaucuggugaagcccgagggcaaagucauagaccucggguguggacgcggcggguggucauauuacugcgccggauuaaagaaagugacugaaguaaagggcuauacaaaaggugggccgggacacgaggaaccaauuccuauggcgaccuacggcuggaaccuggugaagcuucccuccggcaaagauguuuuuuucaugccacccgagaagugugacacgcugcuaugcgauaucggggaaaguagcccuaauccgaccauugaggagggacgaacacucagagugcugaagauggucgaacccugguugagggguaaccaguuuuguaucaaaauacugaauccauacaugccuucuguggucgagacucucgaacaaaugcagcggaagcauggcgggaugcuugugcgcaacccccuguccagaaauucaacccacgagauguauuggguuagcugcggaacaggcaacaucguaucggcugugaacaugacuucuaggauguuacugaaucgauucaccauggcacaccggaaaccuacauacgagcgugacgucgauuugggugccgggaccagacauguggcuguugaaccagagguggccaaccucgacauuaucggacagcgcauugaaaauaucaagaacgagcacaaaaguacuuggcauuaugaugaagacaaucccuacaagacgugggcauaucacggcuccuacgaggucaagccuagcggcucagccuccucuauggugaacgggguagugaggcugcuaacaaaaccaugggauguuauucccauggucacccaaaucgcuaugacugacaccacaccguuuggacagcagcggguguucaaggagaaaguggacacgagaaccccucgcgcgaagagggguacuacacagauaauggaagucaccgccaaauggcuuuggggcuuucugagccgaaauaagaagccacggauuuguacuagagaggaauucacaaggaaaguucgcaguaacgcagcuaucggggccguguuuguagaugagaaucaauggaacuccgcaaaggaagccguggaggacgagcguuucugggaucucguccaccgggaaagagagcugcauaaacagggaaagugcgcuaccugcguguauaauaugaugggcaaaagggaaaagaaguugggugaguuugggaaagccaagggaagccgcgcgaucugguacauguggcugggcgcacgauuccucgaauucgaggcccuuggcuuuaugaacgaggaccacugguucucucgggaaaauucacugagugggguugagggagaagguuuacauaaacugggcuacauuuugagagauauauccaagauccccgggggaaacauguaugcugacgauacagccggcugggacacuaggauuaccgaggaugaccuccagaaugaggcaaaaaucacggaaauuauggagccugaacacgcucugcuagccaccagcaucuuuaagcuuacauaccagaacaaagugguccgcgugcaaagaccagcuaagaacgguacuguaauggauguuauaucucggagggaccagcgugggucgggacaggugggcaccuauggccugaauacauucacuaacauggagguccagcucauccgacaaauggaaucagaggggauuuuucugcccagcgaguuggaaaccccgaauuuagccgagcgcgugcuggauuggcucgaaaagcauggagcagagagacuuaaacggauggcgaucuccggugacgacuguguggucaagccuauugaugacagguucgccacggcucugacagcccuaaacgauaugggcaaaguucgcaaggacaucccccagugggaaccaaguaaaggguggaaugauuggcagcaggugccuuuuugcucucaccacuuccaucaacugauaaugaaggacggaagagagauuguagugcccugucggaaccaggaugagcucgucggcagggcacgagugagccagggugcugggugguccuugcgugaaaccgccugccugggaaagucauacgcacaaauguggcagcuuauguauuuucacagacgcgaccugcggcucgccgcgaaugcuaucuguagugccguuccaguggauuggguccccacuucuaggacaaccuggagcauccaugcacaccaccaguggaugacuaccgaggacauguuauccguguggaacagaguauggauugaagagaauccuuggauggaagauaaaacacauguuucaagcugggaggaggugccauaccugggcaagcgcgaagaccaguggugcggcucuuugauagggcugacggcccgggcuaccugggccacuaacauccaagucgcaauuaaucaggugaggcgacucaucggaaacgagaauuaucuugacuacaugacauccaugaaaagauucaagaacgaaagugauccggagggugcucugugguga

SEQ ID NO: 13342 - RNA, 9879 nt, Artificial Sequence
  derived and/or modified CDS sequence (opt3) from DENV-1__GQ868508__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggauaacccugcuaucccugacauuuaucaaaacuacccuuucucucgauuacgccuggaagacgacagcaauggcucugagcauuguuuccuuguucccgcuguguuuaucaaccacuagccagaaaacaaccuggcucccugugcugcuuggcaguuuugggugcaagccacugacuauguucuugaucacagaaaauaagauuuggggaaggaaaucuuggccccucaacgaggguaucauggccauaggcaucgucuccauucugcuaagcucgcugcuuaagaaugacguaccucucgccgggccccugaucgcuggaggcauguugauugcauguuaugugaucucagguucuagugccgauuuaucccuggagaaagcggcugaaguuagcugggagcaagaagccgagcauucugggaccagccacaacauacucguggaaguccaggacgauggaacgaugaagauuaaagacgaggagcgagaugacacucugaccauccuucugaaggcaacauugcuagccguguccggcguauacccaaugucaaucccugcuacccuguuugugugguauuucuggcagaaaaagaagcagcgcaguggcguccucugggauacacccagcccaccggaaguugagcgggcagugcuggacgaugggauuuacagaauacuucaaaggggauuacugggucguucucaggugggcgucgggguguuccaggacggaguuuuucauacuauguggcacguaacccgcggcgccgugcucauguaucaggguaaacgguuggaaccuuccugggcgucagucaagaaagaccugaucaguuacgggggaggcuggagauuccaaggcagcuggaauacgggggaggaggugcagguuauugcuguggaacccggaaagaacccaaaaaauguccagacaaugcccgguacuuuuaagaccccugagggcgaagugggggccaucgcacucgauuucaagccaggaacauccggcucucccauuguaaacagggaggguaaaaucgucgggcuguacggaaauggcgugguuaccacuucgggcaccuaugugagcgccauagcucaagccaaggcaucacaggaagggccucuuccggagaucgaggacgaagucuuuaaaaagcgaaaccugacaauuauggauuugcacccaggauccgguaaaacgcggcgcuaccuacccgcuauggugagagaggccaucaagaggaagcugcggacucucauuuuagcgccuacccgaguuguggccagugaaauggcagaggcucugaaaggcaugccaaucagauaucagacaaccgccgucaagucugaacauacugggcgcgagauaguggaccuuaugugccacgcuacauucaccaugaggcugcucagccccguacgugugccuaauuacaacaugauuaucauggaugaggcacauuuuacggacccggccuccaucgccgcucggggauauauuucaacuagaguuggcaugggugaagcggcagccaucuucaugacagcuacccccccagggucugucgaggccuuuccucagagcaaugcagugauacaagaugaagagagggacauucccgaacgcaguuggaacuccggauacgauuggaucaccgacuucccaggcaaaacugugugguuugucccuagcauuaagucuggcaaugauaucgccaacuguuugcgaaaaaacgggaagagaguaauacagcugucacggaagacauucgacaccgaguaucagaaaacaaagaauaacgacugggauuacgugguuacuacggacauuuccgagaugggagcuaauuucagggcggaucgcgugaucgacccccguagaugccucaaaccagucauccugaaggaugguccggaacgggugauucuugccggcccuaugcccguuaccguggcaagugcugcccagaggcgcgggcgaaucggaagaaaccaaaauaaagagggcgaccaguacgucuauaugggucagccacuaaacaaugaugaagaccacgcacauuggacagaggccaagaugcuguuggauaacauuaauacucccgaggggauaaucccugcuuuauuugaaccagagcgggaaaagagcgccgcgauugacggcgaguacaggcugcgcggagaagcaagaaaaaccuucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagaucuggacaaaagaaggugagagaaagaaacucaggccucggugguuggacgcucgcaccuauagcgauccgcuggcccuaagagaguuuaaggaauucgcugcaggcaggcggucagugaguggggaccugauccucgagauuggaaaacuuccacagcaccugacuuuacgagcccagaaugcuuuggauaaccuggugaugcuccacaauucugaacagggcgguaaggccuacagacaugcaauggaggaacugcccgacacgauagagacccuuaugcugcucgcguugaucgccguccugacagggggcguuacuuuauuuuuccuauccggaaagggccuggggaaaaccagcauuggacuccuuugugugacagcuucaagugcccuguuguggauggcaagcguagagccucacuggaucgcugccuccauuauccuggaauuuuuccucauggugcugcuuauacccgagccagaucgccaaaggaccccucaggacaaccagcucgcauaugucgugaucggucuguuguuuaugauucugacuguugccgcuaacgaaaugggcuuacuagagacaacgaagaaagaucuggggaucggacauguggcggccgagaaucaccaacacgcaaccaugcucgacgucgaucuucggcccgcuucugccuggacucuguacgccguagcaacaaccgugauuaccccaaugaugcgucauacaaucgaaaacacuacggcuaauauaagcuugaccgccauugcgaaccaggcugccauccugaugggccucgacaaggguuggccuauuuccaaaauggauaucgggguuccgcugcuugcauuaggcugcuacucacaggugaauccccugacacucacugccgcugucuugaugcugguggcacacuaugccauaaucggaccaggccuacaggcgaaggcuaccagagaggcccaaaagaggacagcagccgggauuaugaaaaacccuaccgucgacggaaucguggcuauugaucuggaccccguuguguacgacgccaaguucgaaaaacagcucggccagaucaugcuucugauauuguguacuucucagauucugcucaugcgcacgacaugggcacugugcgagaguaucaccuuagcuacugguccacuuaccacacugugggaagggucgccuggaaaguuuuggaauacuaccaucgccguaagcauggcgaacauuuuccggggcuccuaucucgccggugcaggccuagcuuucucucugaugaaaucauuggggggaggccgaagagggacaggagcccaaggcgagacgcugggugagaaguggaagaggcagcucaaucagcuuagcaaauccgaauuuaacaccuacaagcgcagugggaucauggagguggaucggucugaagcaaaagagggacugaagagaggcgaaacuacaaaacaugcugucagccgugguaccgccaaguugaggugguucguugagcggaaucuggugaagcccgagggcaaagucauagaccucggguguggacgcggcggguggucauauuacugcgccggauuaaagaaagugacugaaguaaagggcuauacaaaaggugggccgggacacgaggaaccaauuccuauggcgaccuacggcuggaaccuggugaagcuucauuccggcaaagauguuuuuuucaugcccccagagaagugugacacgcugcuaugcgauaucggggaaaguagccccaauccuaccauugaggagggacgaacacucagagugcugaagauggucgaaccgugguugagggguaaccaguuuuguaucaaaauacugaaucccuacaugccaucuguggucgagacucucgaacaaaugcagcggaagcacggcgggaugcuugugcgcaacccucuguccagaaauucaacccacgagauguauuggguuagcugcggaacaggcaacaucguaucggcugugaacaugacuucuaggauguuacugaaucgauucaccauggcacaucggaaacccacauacgagcgugacgucgauuugggugccgggaccagacacguggcuguugaaccugagguggccaaccucgacauuaucggacagcgcauugaaaauaucaagaacgagcauaaaaguacuuggcacuaugaugaagacaauccauacaagacgugggcauaucacggcuccuacgaggucaagcccagcggcucagccuccucuauggugaacgggguagugaggcugcuaacaaaaccuugggauguuauuccaauggucacccaaaucgcuaugacugacaccacacccuuuggacagcagcggguguucaaggagaaaguggacacgagaaccccgcgcgcgaagagggguacuacacagauaauggaagucaccgccaaauggcuuuggggcuuucugagccgaaauaagaagccucggauuuguacuagagaggaauucacaaggaaaguucgcaguaacgcagcuaucggggccguguuuguagaugagaaucaauggaacuccgcaaaggaagccguggaggacgagcguuucugggaucucguccaucgggaaagagagcugcacaaacagggaaagugcgcuaccugcguguauaauaugaugggcaaaagggaaaagaaguugggugaguuugggaaagccaagggaagccgcgcgaucugguacauguggcugggcgcacgauuccucgaauucgaggcccuuggcuuuaugaacgaggaccauugguucucucgggaaaauucacugagugggguugagggagaagguuuacacaaacugggcuacauuuugagagauauauccaagaucccagggggaaacauguaugcugacgauacagccggcugggacacuaggauuaccgaggaugaccuccagaaugaggcaaaaaucacggaaauuauggagcccgaacaugcucugcuagccaccagcaucuuuaagcuuacauaccagaacaaagugguccgcgugcaaagaccugcuaagaacgguacuguaauggauguuauaucucggagggaccagcgugggucgggacaggugggcaccuauggccugaauacauucacuaacauggagguccagcucauccgacaaauggaaucagaggggauuuuucugccaagcgaguuggaaacccccaauuuagccgagcgcgugcuggauuggcucgaaaagcacggagcagagagacuuaaacggauggcgaucuccggugacgacuguguggucaagccgauugaugacagguucgccacggcucugacagcccuaaacgauaugggcaaaguucgcaaggacaucccucagugggaacccaguaaaggguggaaugauuggcagcaggugccauuuugcucucaccauuuccaccaacugauaaugaaggacggaagagagauuguagugccuugucggaaccaggaugagcucgucggcagggcacgagugagccagggugcugggugguccuugcgugaaaccgccugccugggaaagucauacgcacaaauguggcagcuuauguauuuucauagacgcgaccugcggcucgccgcgaaugcuaucuguagugccguucccguggauugggucccaacuucuaggacaaccuggagcauccacgcacaccaucaguggaugacuaccgaggacauguuauccguguggaacagaguauggauugaagagaaucccuggauggaagauaaaacacacguuucaagcugggaggaggugccuuaccugggcaagcgcgaagaccaguggugcggcucuuugauagggcugacggcccgggcuaccugggccacuaacauccaagucgcaauuaaucaggugaggcgacucaucggaaacgagaauuaucuugacuacaugacauccaugaaaagauucaagaacgaaagugauccagagggugcucugugguga

SEQ ID NO: 13343 - RNA, 9879 nt, Artificial Sequence
  derived and/or modified CDS sequence (opt3) from DENV-1__GQ868509__SS-prME
agcgugaccaugcugcucaugcuucugccaacagcauuggcuuuccacuuaacuacgcgaggaggggagccucauaugaucgucuccaagcaggaaaggggaaaaucucugcuguuuaagaccucagccgguguuaacaugugcacccucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagaugaguggaacgaccacaauauuugccggccaucuaaaaugccggcucaagauggacaaacugacucuuaaggggaccucuuaugucauguguacaggauccuucaaauuggagaaggaaguggcugagacucagcacgguaccguccuggugcaaguuaaguacgagggcacggaugcgccuugcaaaaucccauucagcacacaggacgaaaagggggugacccagaacggacgucucauuacugcaaaucccaucguaacagauaaagagaagccugucaacauagaaaccgagccacccuuuggcgagucguauauugugguuggugccggggaaaaagcucugaaacuuucuugguucaagaaaggcuccucaaucggaaagauguuugaggccacugcacgcggcgccagaaggauggcuauccugggggacaccgccugggauuucggaaguauugguggcguguuuacaagcgucgggaaauuggugcaucagguauucggaacggcauacggcgugcucuuuuccgguguuucuuggaccaugaagaucgggauuggcauacuguuaacuuggcugggacuaaauagccggucaacaagucucuccaugaccuguaucgcggucggcauggugacacuguaccuuggggugaugguccaagcugacagcggaugcguuauuaacuggaaaggccgagaauugaagugugguucugggaucuucgugacuaacgaggugcacaccuggacggaacaguauaaguuucaggccgauucaccgaaacgccugagugcagccaucggaaaggcuugggaggagggcguaugcgguauuagaagcgucacaaggcucgaaaauauaauguggaaacagaucuccaacgagcugaaucauauuuuacuggaaaacgacaugaaguucaccgugguugugggcgacgccaaugggauccuugcacaaggcaagaagaugauucggccucagcccauggagcacaaauacucuuggaagucguggggcaaggcuaaaaucauaggggccgauauccagaacacuaccuuuauuaucgacggaccagauacaccugaaugucccgacaaucagcgcgcguggaacauuugggaggucgaggauuauggcuucgguaucuuuacuaccaauauaugguugaagcucagagacagcuacacacaaaugugcgaucacaggcugauguccgccgcuauuaaagacucaaaggcagugcaugccgauaugggguauuggaucgaaagugagaaaaacgaaacguggaagcuagcucgugccucuuucauugagguuaagaccuguacuuggccaaaaagccacacacugugguccaauggagugcucgaaucagagaugaucauacccaagaucuacggcgguccuauuagccagcauaacuaucggccaggcuacuucacccagacugcagggccguggcaccugggaaaacuugaguuggacuuugaucugugcgaaggcacaaccguagucguggacgagcacugcgggaaucgaggacccucuuuaagaacgacuaccgugacaggcaagaucauucaugaaugguguugcagguccuguacccucccuccacugcgcuuccggggugaggaugggugcugguacggaauggagaucagacccgucaaagaaaaggaggaaaaccuuguuaggaguauggugagcgcgggcucuggugagguagacuccuuuucacugggcauauugugugccaguauuaugaucgaagaggugaugcgcagccgauggucgcggaagaugcucaugacugggacacuggcugucuuccuacugcucaucaugggacaacugaccuggaaugaccuuauucguuugugcaucauggugggcgccaacgcauccgauagaauggggaugggaacaacuuaucuggcuuuaauggccaccuuuaaaaugaggccuauguucgcaguuggccuccuguuucgccggcuuacgucuagagaggugcugcuacucacaauuggucugagcuuggucgccucaguggaacugccaaacaguuuagaggaacucggggacggacuggcuaugggcauaaugaugcuuaagcuguugaccgaguuccagccccaccagcucuggacuacccugcuaucccugacauuuaucaaaacuacccuuucucucgauuacgcguggaagacgacagccauggcacugagcauuguuuccuuguucccgcuguguuuaucaaccacuagccagaaaacaaccuggcucccugugcugcuuggcaguuuugggugcaagccacugacuauguucuugaucacagaaaauaagauuuggggaaggaaaucuuggccccucaacgaggguaucauggcuauaggcaucgucuccauucugcuaagcucgcugcuuaagaaugacguaccucucgccgggccccugaucgccggaggcauguugauugcuuguuaugugaucucagguucuagugcagauuuaucccuggagaaagccgcggaaguuagcugggagcaagaagcugagcauucugggaccagccacaacauacucguggaaguccaggacgauggaacgaugaagauuaaagacgaggagcgagaugacacucugaccauccuucugaaggccacauugcuagcaguguccggcguauacccaaugucaaucccugccacccuguuucucugguauuucuggcagaaaaagaagcagcgcaguggcgugcugugggauacacccagcccaccggaagucgagcgggcuguucuugacgaugggauuuacagaauauuacaaaggggacugcucggucguucucaggugggcgugggggucuuccaggacggaguguuucauacuauguggcacguuacccgcggcgcaguauugauguaucaggguaaacggcuggaaccuuccugggccucagugaagaaagaccucaucaguuacgggggaggcuggagauuccaaggcagcuggaauacgggggaggagguccaggugauugcgguugaacccggaaagaaccccaaaaaugugcagacaacucccgguaccuuuaagacaccugagggcgaagucggggcuaucgcccuggauuucaagccaggaaccuccggcucucccauugugaacagggaggguaaaaucguagggcuuuacggaaauggcgucgugacuaccucgggcacauauguuagcgcaauagcccaagcuaaggccucacaggaagggccucugccggagaucgaggacgaaguguuuaaaaagcgaaacuugacgauuauggaucuacacccaggauccgguaaaacucggcgcuaccugcccgcaaucgucagagaggcuauuaagaggaagcuccggaccuuaauccuggccccuacacgagugguugcgagugaaauggccgaggcacuuaaaggcaugccaauaagauaucagaccacugcugugaagucugaacauacagggcgcgagauugucgaccugaugugccacgccaccuucacgaugaggcucuugagccccgugcguguaccuaauuacaacaugaucaucauggaugaggcucauuuuacugacccggcauccauugccgcccggggauauaucucaacaagagugggcaugggugaagcugcggcaauauucaugaccgccacacccccagggucuguugaggcuuuuccucagagcaaugccgucauucaagaugaagagagggacauccccgaacgcaguuggaacuccggauacgauuggauuacugacuucccaggcaaaacagugugguuugugccuagcaucaagucuggcaaugauauagcaaacugucugcggaaaaacgggaagagagucauucagcucucaagaaagaccuucgacacagaguaucagaaaacuaagaauaacgacugggauuacguagugacgaccgacaucuccgagaugggagccaauuucagggcugaucgcguuaucgacccccguagaugccugaaaccagugauucuuaaggaugguccggaacgggucauccuagcgggcccuaugcccgugacaguugccagugcagcucagaggcgcgggcgaauuggaagaaaccaaaauaaagagggcgaccaguacguguauaugggucagccacugaacaaugaugaagaccacgcccauuggacugaggcaaagauguuguuagauaacauaaauacccccgaggggaucauuccugcccuguuugaaccagagcgggaaaagagcgcugccaucgacggcgaguacaggcuccgcggagaagcgagaaaaacauucgucgagcugaugaggcggggcgaucuucccguguggcugucguauaagguagcaucugagggguuucaguacuccgaccgucgcuggugcuucgauggagaacgaaacaaucaagugcucgaggaaaacauggacguugagaucuggaccaaagaaggugagagaaagaaauugaggccucgguggcuggacgcccgcacuuauagcgauccgcuagcucugagagaguuuaaggaguucgccgcuggcaggcggucagucaguggggaccucauucuugagauaggaaaacugccacagcacuuaacguugcgagcacagaaugcccuggauaaccucgugaugcugcacaauucugaacagggcgguaaggcuuacagacaugccauggaggaacuucccgacaccaucgagacacugaugcucuuggcacugauugcgguguuaacugggggcgucacccuauuuuuccuguccggaaagggccucgggaaaacaagcaucggacuucuguguguuaccgccucaagugcuuugcuguggauggccagcguggagccucacuggauugcagcuuccaucauacucgaauuuuuccugaugguacuucucauccccgagccagaucgccaaaggacuccucaggacaaccagcuggccuauguggucauugguuugcuguuuaugaucuuaacaguggcagccaacgaaaugggccuacuggagacgaccaagaaagaucucgggauuggacauguugcugcggagaaucaccaacacgccacuaugcuugacguggaucugcggcccgcaucugcuuggacauuguacgccgucgccaccaccguaaucacaccaaugaugcgucauacuauagaaaacacgaccgcaaauauuagccugacagcuaucgccaaccaggcggcuauucucaugggccuggacaaggguuggccuaucuccaaaauggauauaggggugccgcuuuuagcccugggcugcuacucacagguuaauccccucacuuugaccgcagccgugcugaugcuagucgcucacuaugcaaucauuggaccaggccugcaggccaaggcgacaagagaggcucaaaagaggaccgccgcagggaucaugaaaaacccuacuguggacggaauugucgccaucgaucucgaccccgugguuuacgacgcuaaguucgaaaaacagcuuggccagauaaugcuguugauucuguguacgucucagauccuccugaugcgcacaaccugggccuuaugcgagaguaucacucuugcaaccgguccacugacaacucucugggaagggucgccuggaaaguuuuggaauaccacaauugcugugagcauggccaacaucuuccggggcuccuaucuagcgggugccggccuggcauucucuuugaugaaaucacuagggggaggccgaagagggacgggagcucaaggcgagacccucggugagaaguggaagaggcagcuuaaucagcugagcaaauccgaauuuaacacuuacaagcgcagugggauaauggagguagaucggucugaagccaaagagggauugaagagaggcgaaacaaccaaacaugcagugagccgugguacugcuaagcugaggugguucgucgagcggaaucucguuaagcccgagggcaaagugauugacuuaggguguggacgcggcggguggucauauuacugcgccggacugaagaaagucacagaagugaagggcuauaccaaaggugggccgggacacgaggaaccaaucccuauggccacguacggcuggaaccuuguaaagcugcauuccggcaaagauguguuuuucaugcccccagagaagugugacacccuacucugcgauauuggggaaaguagccccaauccuacaaucgaggagggacgaacucugagaguuuugaagaugguggaaccguggcugagggguaaccaguuuuguauaaaaauccucaaucccuacaugccaucugucguggagacccuugaacaaaugcagcggaagcacggcgggaugcugguccgcaacccuuuauccagaaauucaacacacgagauguauugggugagcugcggaacuggcaacauuguuucggcgguaaacaugaccucuaggaugcuguugaaucgauucacaauggcucaucggaaacccaccuuugagcgugacguggaucucggugcagggacuagacacgucgccguggaaccugagguugcuaaccuggacaucauuggacagcgcaucgaaaauauuaagaacgagcauaaaaguacguggcacuacgaugaagacaauccauauaagacaugggccuaccacggcuccuaugaggugaagcccagcggcucagcauccucuauggucaacggggugguaaggcuacuuaccaaaccuugggaugugaucccaaugguuacucaaauagccaugaccgacacaacgcccuucggacagcagcgggucuuuaaggagaaaguggacaccagaacuccgcgcgcuaagagggguacaacccagauuauggaagugacugcgaaauggcuguggggcuuccucagccgaaauaagaagccucggaucuguacaagagaggaauuuaccaggaaaguccgcaguaacgccgcaaucggggcuguuuucguggaugagaaucaauggaacuccgccaaggaagcaguagaggacgagcguuuuugggaucuggugcaucgggaaagagaguugcacaaacagggaaagugcgccacaugcgucuacaauaugaugggcaaaagggaaaagaagcugggugaguucgggaaagcuaagggaagccgcgccauuugguauauguggcucggcgcgcgauuccuugaauuugaggcacugggcuucaugaacgaggaccauugguuuucucgggaaaauucauuaagugggguggagggagaaggucugcacaaauugggcuacauacucagagauaucuccaagauuccagggggaaacauguacgccgacgauacugcuggcugggacaccaggaucacggaggaugaccugcagaaugaggccaaaauuaccgauaucauggaacccgagcaugcacuacuugcuacaagcauauucaagcugacuuaucagaacaaaguugugcgcguccaaagaccugccaagaacgguaccgugauggacguaaucucucggagggaucagcgugggucgggacagguuggcacauacggccucaauacuuuuaccaacauggaagugcagcugauucgacaaauggagucagaagggaucuucuugccaagcgaguuagagacgcccaaucuggcugaacgcguccucgacuggcuugagaagcacggagccgaaagacugaaacggauggcaauuuccggugacgauuguguggugaagccgaucgacgauagguuugcgacagcccuaaccgcucugaacgacaugggcaaaguccgcaaggauauaccucagugggagcccaguaaaggguggaaugacuggcagcagguuccauucugcucucaccauuuucaccaacucauuaugaaggauggaagagaaaucgugguaccuugucggaaccaggacgaguuggugggcagggcccgagucagccagggugcaggguggucccugcgugagacugcuugccuuggaaagucauaugcccaaauguggcagcugauguacuuccauagacgcgaucuccgguuagcagccaaugcgaucuguagugcugugcccguugacugggugccaacaucuaggaccacuuggagcauucacgcccaccaucaguggaugaccacagaagauaugcuguccgucuggaacagaguguggauagaggaaaaucccuggauggaggacaaaacgcacguaucaagcugggaagagguuccuuauuugggcaagcgcgaggaccaguggugcggcucucugaucgggcucaccgcacgggccacuugggcuacaaacauucaaguggccaucaaucaggucaggcgacuuauuggaaacgaaaauuaccuggauuauaugaccuccaugaaaagauuuaagaacgagagugacccagaaggugcacuaugguga

SEQ ID NO: 13344 - RNA, 9879 nt, Artificial Sequence
  derived and/or modified CDS sequence (opt3) from DENV-1__GQ868510__SS-prME
agcgugaccaugcugcucaugcuucugcccacagcauuggcuuuccacuuaacuacgcggggcggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggaggccaccggcgcgagaagcgaagcguggcccuggcaccccaugucgguuuggggcucgagacucguaccgaaacauggauguccucugagggagccuggaaacagauccagcggguggaaacuugggcucugaggcacccuggcuucaccguuauugcacuguuucucgcccaugcuaucggcacaucgauuacccaaaaggggaucauauucaucuuacugaugcuugugacgccaucaauggccaugcggugcgucggaauugguaaccgcgacuuuguggagggcuugagcggggcgacuuggguagauguugugcuggagcacggaaguugugucacaaccauggcaaagaauaaacccacucuagacaucgaacuccugaagacagaggugaccaacccugccauucuuagaaaacugugcaucgaagcuaagauauccaauacgaccacagauucuagguguccaacucagggcgaggccaccuugguggaagaacaggacgcaaacuucgucugccggcgcacauuuguugaucgagguugggggaauggauguggccucuucggcaaagggagccuguuaacuugcgcuaaguuuaagugcgugaccaaacuggagggaaagauuguacaguacgaaaaccucaaauauuccgugaucgucacagugcacaccggugaccaacaucagguuggcaaugagacuacggaacacgggacaauugccaccaucacuccccaggcgccuaccucagagauccagcuuacagauuacggagcccugaccuuggacuguaguccaagaacuggccuagacuucaacgaaauggugcugcucacaaugaaggagaaaagcuggcugguccauaagcaaugguuucuugaucugccguugcccuggacgucuggugcauccaccucacaggagacuuggaauaggcaggaccuccuggugacauucaaaaccgcucacgccaagaagcaagaaguaguuguguuagggagccaggagggcgcuaugcacacagcccugacuggagcaaccgaaauucagacgaguggcaccacaacuauauuugccgggcaucuaaaaugccggcucaagauggauaaacugacccuuaagggaacaucuuaugucauguguacugguuccuucaaauuggagaaggaaguggcugagacccagcacggcacgguccuggugcaaguuaaguacgaggggacagacgcgccuugcaaaaucccauucagcacccaggaugaaaagggagugacucagaacggccgucucauuacagcaaaucccaucguaaccgacaaagagaagccugucaacauagaaacugagccacccuuuggugagucguauauugugguuggggccggcgaaaaagcucugaaacuuucuugguucaagaaaggauccucaaucggcaagauguuugaggccaccgcacgcggggccagaaggauggcuauccugggagauacagccugggacuucgguaguauuggcgggguguuuacgagcgucggaaaauuggugcaucagguauucggcaccgcauacggugugcucuuuuccgggguuucuuggacuaugaagaucggcauuggaauacuguuaacauggcugggccuaaauagccggucaaccagucucuccaugacauguaucgcggucgggauggugacucuguaccuuggagugaugguccaagcugauagcggcugcguuauuaacuggaaaggucgagaauugaagugugggucuggaaucuucgugaccaacgaggugcacacguggacagaacaguauaaguuucaggccgacucaccgaaacgccugagugcagccaucggcaaggcuugggaggaggguguaugcggcauuagaagcgccaccaggcucgaaaauauaauguggaaacagaucuccaacgagcugaaucauauuuuacuggaaaacgauaugaaguucacugucgugguuggggacgcaaauggaauccuugcucaaggcaaaaagaugauucggccucagcccauggagcacaaauacucuuggaagucgugggggaaggccaaaaucauaggagcggacauccagaacaccacauuuauuaucgauggcccagacacuccugaaugucccgauauucagcgcgccuggaauaucugggagguggaggacuaugguuucgggauauuuaccacaaacauuugguugaagcucagagauagcuacacgcaaaugugcgaccacaggcugauguccgcugcaaucaaagauucaaaggccguccaugcugacaugggauauuggauugaaagugagaaaaaugaaaccuggaagcuagcccgugcaucuuucaucgaggugaagacuuguacauggccaaaaagccacacccugugguccaacggcguucucgaaucagagaugauaauccccaagauuuacgguggcccuaucagccagcauaauuaucggccaggguacuucacucagacagcgggaccguggcaccugggcaaacuugaguuggauuuugaccugugcgaagggaccacggugguagucgaugagcacugcggaaaccgaggccccucuuuaagaacuaccacagugaccgguaagauuauccaugaaugguguugcagguccuguacucucccuccacugcgcuucagaggggaagacggaugcugguacggcauggagauaagacccgugaaagaaaaggaggaaaaucuugucaggaguaugguuagcgccgguucuggcgagguggauuccuuuucacuggggauuuugugugcuaguaucaugaucgaagagguaaugcgcagccgauggucgcggaagaugcucaugacaggaacccuggccguguuccuacugcucauuaugggccaacugacauggaaagaccuuauccguuugugcauuauggucggggcaaacgcuuccgacagaaugggaaugggcacuaccuaucuggccuuaauggcaacguuuaagaugaggccuauguucgccgugggucuccuguuucgccggcuuacaucuagagagguucugcuacucaccauagggcugagcuugguggcuucagucgaacugccaaauaguuuagaggaacucggagauggccuggcgaugggcaucaugaugcuuaaacuguugacugaguuccagccccaccagcucuggaccacacugcuaucccugacuuuuauuaagaccacgcuuucucucgacuacgccuggaaaacaaccgcaauggcucugagcaucguguccuuguucccgcuguguuuaucaacuacaagccagaagaccacuuggcucccuguucugcuugggagucugggaugcaagccauugacaauguuucucauuaccgaaaacaaaaucugggguaggaagucuuggccccugaacgagggcauaauggccaucgggauuguguccauccuacugagcucgcuucucaaaaaugaugucccucuggccggacccuugauugcuggcgguauguuaaucgcauguuauguaauaucagggucuagugccgaccugucccucgagaaggcggcugaagugagcugggagcaagaagccgagcauucuggaacgagccacaacauucugguugaagugcaggaugacggcacuaugaaaaucaaggaugaggagcgagacgauacccuuacaauccuguugaaagcaacccuacuggccgucuccggcguguacccaaugucaauuccugcuacacucuucguaugguauuuuuggcagaagaagaaacagcgcaguggggugcugugggacacucccagcccaccggaagucgagcgggcaguucuugaugacggaauauacagaaucuuacaaaggggucugcucggccguucucaggugggggugggagucuuccaggauggcguguuccauaccauguggcacguuacgcgcggugccguauugauguaucaggggaagcggcuggaaccuuccugggcgucagugaaaaaggaccucauuaguuacggaggcggcuggagauuucaagggagcuggaauacaggagaggagguccaggugaucgcuguugaacccgguaaaaacccaaagaaugugcagacuacccccggcacauucaagaccccugagggggaagucggagccauugcacuggacuuuaaaccaggcacuuccgguucucccaucgugaacagggaggggaagauaguaggacuuuacggcaauggcgucgugaccacaucggggacguauguuagcgccaucgcucaagccaaagcaucacaggaaggaccucugccggagauugaggaugaaguguucaagaaacgaaacuugacuaucauggaccuacacccagguuccggcaagacccggcgcuaccugcccgcuauugucagagaggccaucaagaggaaacuccggacauuaauacuggcgccuacccgagugguugccagugaaauggcagaggcucuuaaggggaugccaauuagauaucagacuacagccgugaaaucugaacauaccggacgcgagaucgucgaucugaugugccacgcuacguuuacuaugaggcucuugagccccgugcguguaccuaauuacaacaugaucauuauggacgaggcacauuucacagauccggccuccaucgccgcucggggcuauauaucaaccagaguggguaugggggaagcggcagccauuuuuaugaccgcuacucccccaggaucuguugaggccuucccucagagcaaugcagucauccaagacgaagagagggauauucccgaacgcaguuggaacuccggcuacgacuggaucacagauuuuccaggcaagaccgugugguucgugccuagcauaaaaucugggaaugacauugccaacugucugcgaaagaauggaaagagagucauccagcucucacggaaaacauuugauacugaguaucagaagacgaaaaacaacgacugggacuacguagugaccacagauaucuccgagaugggugcuaauuucagggcggaccgcguuauugauccccguagaugccugaagccagugauccuuaaagacggcccggaacgggucauucuagccgggccuaugcccgugacuguugcaagugcugcccagaggcgcggacgaauaggcagaaaccaaaauaaggagggugaucaguacguguauauggggcagccacugaacaaugacgaagaucacgcacauuggaccgaggccaagauguuguuagacaacaucaauacacccgagggcauuaucccugcucuguucgaaccagagcgggagaaaagcgccgcgaucgauggagaguacaggcuccgcggcgaagcaagaaagaccuuugucgagcugaugaggagaggggaccuucccguguggcugucguauaaaguagccucugagggauuccaguacuccgaucgucgcuggugcuuugacggugaacgaaacaaucaagugcucgaggaaaacauggauguugagauuuggacuaaggaaggcgagaggaagaaguugaggccucgguggcuggacgcucgcacguauagcgacccgcuagcccugagagaguucaaagaauuugcugcagggaggcggucagucaguggagaucucauacuugagaucggcaagcugccacagcacuuaaccuugcgagcccagaaugcucuggacaaccucgugaugcugcacaauucugaacagggugggaaggccuacagacaugcaauggaggaacuucccgauacaauugagacucugaugcucuuggcgcugaucgccguguuaaccggcggagucacacuauucuuucuguccggcaaagggcucggaaagaccagcauuggucuucuguguguuacugcuucaagugccuugcuguggauggcaagcguggagccucacuggaucgcugccuccauaauccucgaguucuuucugaugguacuucucauucccgagccagaccgccaaaggacaccucaggauaaccagcuggcauauguggucaucggcuugcuguucaugauuuuaacgguggccgcuaaugaaauggggcuacuggagaccacuaaaaaggaccucggaaucggccauguugcggccgagaaccaccaacacgcaacaaugcuugauguggaccugcggcccgcuucugccuggaccuuguacgccgucgcaaccacaguaauaacuccaaugaugcgucauacgauugaaaacaccacagcuaauaucagccugacugccauugcgaaccaggcugccauccucaugggucuggauaaaggguggccuauauccaagauggacaucggcgugccgcuuuuagcacugggaugcuacucacagguuaauccccucaccuugacagccgcugugcugaugcuagucgcacacuaugccauuaucggcccagggcugcaggcgaaggcuaccagagaggcccaaaagagaacugcagccggaauuaugaagaacccuacgguggauggcaucgucgcuauagaccucgaucccgugguuuacgacgccaaauuugaaaagcagcuuggucagauuaugcuguugauccuguguacaucucagauccuccugaugcgcaccacuugggcauuaugcgagaguauuacccuugcuacagggccacugacuacccucugggaaggaucgccuggcaaauucuggaauacaacgaucgccgugagcauggcgaacauauuucgggguuccuaucuagccggcgcagggcuggcuuucucuuugaugaagucacugggaggcgggcgaagaggaaccggcgcccaaggugagacucucggggagaaguggaaaaggcagcuuaaucagcugagcaaguccgaguucaacacauacaaacgcaguggaauuauggagguagaccggucugaagcaaaggagggcuugaaaagaggugaaaccacuaagcaugcugugagccguggcacagccaagcugaggugguuugucgagcggaaucucguuaaacccgaggggaaggugaucgauuuaggauguggccgcgggggauggucauauuacugcgccggccugaaaaaggucaccgaagugaaagguuauacgaaagggggaccgggccacgaggaaccaauuccuauggcgaccuacggcuggaaccuuguaaaacugcauuccgggaaggacguguucuuuaugcccccagagaagugugauacacuacucugcgacaucggagaaaguagccccaauccuacuauagaggagggucgaacccugagaguuuugaaaaugguggaaccguggcugaggggcaaccaguucuguaucaagauucucaaucccuacaugccaucugucguggagacacuugaacaaaugcagcggaaacacgggggaaugcugguccgcaacccuuuauccagaaauucaacucacgagauguauugggugagcugcggcaccgguaacaucguuucggcuguaaauaugacaucuaggaugcuguugaaccgauuuaccauggcacaucggaagcccacuuacgagcgugauguggaccucggggccggaacgagacacgucgcuguggaaccugagguugccaaccuggauauuaucggccagcgcauugaaaauaucaaaaacgagcauaagaguacauggcacuaugacgaagauaauccauacaagaccugggcauaucacggcuccuacgaggugaaacccagcgggucagccuccucuauggucaacggagugguaaggcuacuuacuaagccuugggacgugauaccaaugguuacccaaauugcuaugacagauacgacccccuucggucagcagcgggucuuuaaagagaagguggacacuagaacaccgcgcgcgaaaaggggcaccacucagaucauggaagugacagccaaguggcuguggggguuccucagccgaaauaagaaaccucggaucuguaccagagaggaauuuacaaggaagguccgcaguaacgcagcuauuggagccguuuucguggacgagaaucaauggaacuccgcaaaagaagccguagaggaugagcguuuuugggaccuggugcaucgggaaagagaguugcacaagcagggcaaaugcgcuacuugcgucuauaauaugauggguaagagggaaaagaaacugggggaguucggaaaggccaaaggcagccgcgcgauaugguacauguggcucggcgcacgauuucuugaguucgaggcccugggguucaugaacgaggaucauugguuuucucgggaaaauucauuaaguggaguggagggugaaggccugcacaaguugggguacauccucagagacauuuccaaaaucccaggaggcaacauguaugcugaugacaccgccgguugggauacgaggauuaccgaggacgaucugcagaaugaggcaaagaucacagacauaauggaacccgagcaugcucuacuugccacuagcaucuucaaacugaccuaccagaacaagguugugcgcguccaaagaccugcuaagaaugggacagugauggauguaauuucucggagggaccagcguggaucgggccagguuggcacuuaugggcucaacaccuuuacgaacauggaagugcagcugauccgacaaauggagucagaaggaauuuucuugccaagcgaguuagagacacccaaucuggccgaacgcguccucgauuggcuugguaaacacggcgcagagagacugaagcggauggcgaucuccggggacgacuguguggugaaaccgauagaugacagguuugccaccgcucuaacugcccugaacgauaugggaaagguccgcaaagacauuccucagugggaacccaguaagggcuggaaugauuggcagcagguuccauucugcucucaccauuuucaccaacucaucaugaaggacgguagagagaucgugguaccuugucggaaccaggaugaauugguggggagggcacgagucagccagggagcuggcuggucccugcgugagacagccugccuuggcaaaucauacgcacaaauguggcagcugauguauuuccauagacgcgaccuccgguuagccgcgaaugcuauuuguagugccgugcccguugauugggugccaaccucuaggacuaccuggagcauacacgcacaccaucaguggaugacaacggaggacaugcuguccgucuggaacagaguguggaucgaagagaaucccuggauggaagauaagacccacguaucaagcugggaggaaguuccuuacuuggggaaacgcgaggaccaguggugcggaucucugauuggucucacugcccgggcuacaugggccaccaacauccaaguggcaauuaaucaggucaggcgacuuaucggcaacgagaauuaucuggacuacaugacuuccaugaagagauuuaaaaacgaaagugauccagagggggcucuaugguga

SEQ ID NO: 13345 - RNA, 9879 nt, Artificial Sequence
  derived and/or modified CDS sequence (opt3) from DENV-1__GQ868511__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaccugccggcucaaaauggacaagcugacacuuaaagggacuucuuaugucauguguaccggauccuucaaguuggagaaagaaguggcugagacgcagcacgguacaguccuggugcaaguuaaguacgagggcaccgaugcgccuugcaagaucccauucagcacucaggacgaaaaaggggugacacagaacggacgucucauuaccgcaaaucccaucguaacugauaaggagaaaccugucaacauagaaaccgagccacccuuuggcgagucguauauugugguuggugccggggaaaaggcucugaaacuuucuugguucaagaagggcuccucaaucggaaaaauguuugaggccacagcacgcggcgccagaaggauggcuauccugggggacacggccugggauuucggaaguauugguggcguguuuaccagcgucgggaaguuggugcaucagguauucggaacugcauacggcgugcucuuuuccgguguuucuuggacaaugaaaaucgggauuggcauacuguuaaccuggcugggacuaaauagccggucaacaagucucuccaugacuuguaucgcggucggcauggugacccuguaccuuggggugaugguccaagcugacagcggaugcguuauuaacuggaagggccgagaauugaaaugugguucugggaucuucgugacgaacgaggugcacacauggaccgaacaguauaaguuucaggccgauucaccgaagcgccugagugcagccaucggaaaagcuugggaggagggcguaugcgguauuagaagcgccacuaggcucgaaaauauaauguggaagcagaucuccaacgagcugaaucauauuuuacuggaaaacgacaugaaauucaccgucgugguuggcgacgcaaaugggauccuugcucaaggaaagaaaaugauucggccucagcccauggagcacaaguacucuuggaaaucguggggcaaggccaagaucauaggggcggauauccagaacacaacuuuuauuaucgacggaccagauaccccugaaugucccgacaaucagcgcgccuggaacauuugggagguggaggauuauggcuucgguaucuuuacaacgaauauaugguugaaacucagagacagcuacacccaaaugugcgaucacaggcugauguccgcugcaauuaaggacucaaaagccguccaugcugauaugggguauuggaucgaaagugagaagaacgaaacuuggaaacuagcccgugcaucuuucauugaggugaagacauguaccuggccaaagagccacacucugugguccaauggaguucucgaaucagagaugaucauacccaaaaucuacggcgguccuauuagccagcauaacuaucggccaggcuacuucacacagaccgcggggccguggcaccugggaaagcuugaguuggacuuugaucugugcgaaggcacgacugugguagucgacgagcacugcgggaaucgaggacccucuuuaagaaccacaaccgugacuggcaaaaucauucaugaaugguguugcagguccuguacacucccuccacugcgcuuccggggugaggaugggugcugguacggaauggagaucagacccgugaaggaaaaagaggaaaaccuugucaggaguaugguuagcgccggcucuggugagguggacuccuuuucacugggcauauugugugcuaguauuaugaucgaagagguaaugcgcagccgauggucgcggaagaugcucaugaccgggacacuggccguguuccuacugcucgucaugggacaacugacuuggaaugaccuuauccguuugugcauuauggugggcgcaaacgcuuccgauagaauggggaugggaaccacguaucuggccuuaauggcaacauuuaagaugaggccuauguucgccguuggccuccuguuucgccggcuuaccucuagagaggugcugcuacucacuaucggucugagcuuggucgcuucaguggaacugccaaacaguuuagaggaacucggggacggacuggcgaugggcauuaugaugcuuaaacuguugaccgaguuccagccccaccagcucuggacaacucugcuaucccugaccuuuauaaagacgacacuuucucucgauuacgccuggaaaaccacugcaauggcucugagcaucguuuccuuguucccgcuguguuuaucaacaaccagccagaagacuacauggcucccugugcugcuuggcaguuuugggugcaaaccacugaccauguucuugauuacggaaaauaagaucuggggaaggaagucuuggccccucaacgaggguauuauggccaucggcauagucuccauccugcuaagcucgcugcuuaaaaaugacguaccucucgccgggccccugauugcuggaggcauguugaucgcauguuaugugauuucagguucuagugccgauuuaucccuggagaaggcggcugaaguuagcugggagcaagaagccgagcauucugggacuagccacaacauccucguggaaguccaggacgauggaaccaugaaaauaaaggacgaggagcgagaugacacacugaccauucuucugaaagcaacauugcuagccguguccggcguauacccaaugucaaucccugcuacucuguuugugugguauuucuggcagaagaaaaagcagcgcaguggcguccucugggauacccccagcccaccggaaguugagcgggcagugcuggacgaugggaucuacagaauucuucaaaggggauuacugggucguucucaggugggcgucgggguguuccaggacggaguuuuucauacgauguggcacguaacacgcggcgccgugcucauguaucaggguaagcgguuggaaccuuccugggcgucagucaaaaaggaccugauaaguuacgggggaggcuggagauuccaaggcagcuggaauacuggggaggaggugcagguuaucgcuguggaacccggaaaaaacccaaagaauguccagaccacacccgguaccuuuaaaacuccugagggcgaagugggggccauugcacucgauuucaagccaggaaccuccggcucucccaucguaaacagggaggguaagauugucgggcuguacggaaauggcgugguuacaacgucgggcacuuaugugagcgccaucgcucaagccaaagcaucacaggaagggccucuuccggagauagaggacgaagucuuuaagaaacgaaaccugaccaucauggauuugcacccaggauccgguaagacacggcgcuaccuacccgcuauugugagagaggccaucaaaaagaagcugaggacccucauuuuagcgccuacucggguuguggccagugaaauggcagaggcucugaaaggcaugccaauccgauaucagacaaccgccgucaagucugaacauacggggagagagauaguggaccuuaugugccacgcuacuuucacaaugcgccugcucagccccguaagggugccuaauuacaacaugauuaucauggaugaggcacauuuuaccgacccggccuccaucgccgcucguggauauauuucaacccggguuggcaugggugaagcggcagccaucuucaugacugcuacacccccagggucugucgaggccuuuccucagagcaaugcagugauacaagaugaagagagagacauucccgaaaggaguuggaacuccggauacgauuggaucaccgacuucccaggcaaaacagugugguuugucccuagcauuaagucuggcaaugauaucgccaacuguuugcgcaaaaacgggaagcgaguaauacagcugucaagaaagacuuucgacacggaguaucagaaaaccaagaauaacgacugggauuacgugguuacaacugacauuuccgagaugggagcuaauuuccgggcggauagggugaucgacccccgccguugccucaaaccagucauccugaaggaugguccggaaagagugauucuugccggcccuaugcccguuaccguggcaagugcugcccagcggagggggcgcaucggacgaaaccaaaauaaagagggcgaccaguacgucuauaugggucagccacuaaacaaugaugaagaccacgcacauuggacagaggccaagaugcuguuggauaacauuaauacccccgaggggauaaucccugcuuuauuugaaccagagagagaaaagagcgccgcgauugacggcgaguaccggcugaggggagaagcacgcaaaacuuucguggagcucaugagaaggggcgaucugcccguauggcuuucguauaagguggccucugagggguuucaguacuccgaccggcguuggugcuucgauggagaacgcaacaaucaaguucuggaggaaaacauggacgucgagaucuggacgaaagaaggugagcgaaagaaacucagaccuaggugguuggacgcucggaccuauagcgauccgcuggcccuacgcgaguuuaaggaauucgcugcaggcagaaggucagugaguggggaccugauccucgagauuggaaaacuuccacagcaccugacauuacgggcccagaaugcuuuggauaaccuggugaugcuccacaauucugaacagggcgguaaggccuaccgacaugcaauggaggaacugcccgacacuauagagacccuuaugcugcucgcguugaucgccguccugacagggggcguuaccuuauuuuuccuauccggaaagggccuggggaaaacuagcauuggacuccuuugugugacagcuucaagugcccuguuguggauggcaagcguagagccucacuggaucgcugccuccauuauccuggaauuuuuccucauggugcugcuuauacccgagccagauagacaacgcacgccucaggacaaccagcucgcauaugucgugaucggucuguuguuuaugauucugaccguugccgcuaacgaaaugggcuuacuagagacuacaaagaaagaucuggggaucggacauguggcggccgagaaucaccaacacgcaaccaugcucgacgucgaucuuaggcccgcuucugccuggacccuguacgccguagcaacaacugugauuacgccaaugaugcggcauaccaucgaaaacacaacugcuaauauaagcuugaccgccauugcgaaccaggcugccauccugaugggccucgacaaggguuggccuauuuccaaaauggauaucgggguuccgcugcuugcauuaggcugcuacucacaggugaauccccugacacucaccgccgcugucuugaugcugguggcacacuaugccauaaucggaccaggccuacaggcgaaggcuacucgugaggcccaaaagagaacggcagccgggauuaugaaaaacccuacagucgacggaaucguggcuauugaucuggaccccguuguguacgacgccaaguucgaaaaacagcucggccagaucaugcuucugauauuguguaccucucagauucugcucaugaggacuaccugggcacugugcgagaguaucacauuagcuacugguccacuuaccacacugugggaagggucgccuggaaaguuuuggaauacgaccaucgccguaagcauggcgaacauuuuccgcggcuccuaucucgccggugcaggccuagcuuucucucugaugaaaucauuggggggaggccggcgagggacuggagcccaaggcgagacacugggugagaaguggaagagacagcucaaucagcuuagcaaauccgaauuuaacgcauacaagaggagugggaucauggagguggaucgcucugaagcuaaagagggacugaagcggggcgaaaccacuaaacaugccgucagcagagguacagccaaguugcguugguucguugagaggaaucuggugaagcccgagggcaaagucauagaccucggguguggacggggcggguggucauauuacugcgcgggauuaaagaaagugaccgaaguaaagggcuauacgaaaggugggccgggacacgaggaaccaauuccuauggcuaccuacggcuggaaccuggugaagcuucauuccggcaaagauguuuuuuucaugcccccagagaagugugacacacugcuaugcgauaucggggaaaguagccccaauccuacuauugaggagggacgcacccuccgagugcugaagauggucgaaccgugguugagagguaaccaguuuuguaucaaaauacugaaucccuacaugccaucuguggucgagacacucgaacaaaugcagaggaagcacggcgggaugcuugugcggaacccucugucccgcaauucaacucacgagauguauuggguuagcugcggaaccggcaacaucguaucggcagugaacaugacaucuagaauguuacugaauagguucaccauggcccaucgaaaacccacuuacgagcgggacgucgauuugggugcugggacgcgucacguggccguugaaccugagguggcaaaccucgacauuaucggacagagaauugaaaauaucaagaacgagcauaaaaguacauggcacuaugaugaagacaauccauacaagaccugggccuaucacggcuccuacgaggucaagcccagcggcucagcuuccucuauggugaacgggguagugcgccugcuaacuaaaccuugggauguuauuccaauggucacccaaaucgcgaugacagacacgacccccuuuggacagcagaggguguucaaggagaaaguggacacucggacaccgagagccaagcgcgguaccacucagauaauggaagucacagcaaaauggcuuuggggcuuucugagcaggaauaagaagccucgaauuuguacccgggaggaauucacaagaaaaguuaggaguaacgcugccaucggggcaguguuuguagaugagaaucaauggaacuccgccaaggaagcuguggaggacgagagcuucugggaucucguccauaaagaacgcgagcugcacaagcagggaaaaugcgccacuugcguguauaauaugaugggcaagcgugaaaagaaauugggugaguuugggaaggcgaaaggaucucgggcaaucugguacauguggcugggcgccagauuccucgaauucgaggcucuuggcuuuaugaacgaggaccauugguucucaagggaaaauagucuguccgggguugagggagaagguuuacacaagcugggcuacauuuugcgcgauauaagcaaaaucccagggggaaacauguaugccgacgauaccgcaggcugggacacgcgaauuaccgaggaugaccuccagaaugaggcuaagaucacagaaauuauggagcccgaacaugcccugcuagcuacuucuaucuuuaaacuuaccuaccagaacaaggugguccgggugcaaagaccugccaagaacgguacaguaauggauguuauaucgaggcgcgaccagagagggucaggacaggugggcacuuauggccugaauaccuucacgaacauggggguccagcucauccggcaaauggagagcgaaggaauuuuucugccauccgaguuggagacacccaauuuagcagaaagggugcuggauuggcucgagaaacacggugcggaacgucuuaagcgaauggccaucaguggcgacgacuguguggucaaaccgauugaugaccgcuucgcuaccgcccugacugcacuaaacgauauggggaagguuagaaaagacaucccucagugggagcccucuaagggauggaaugauuggcagcaggugccauuuugcagccaccauuuccaccaacugauaaugaaggacggccgggaaauuguagugccuuguaggaaccaggaugagcucgucggucgcgcuagagugucccagggggccggauggucauugcgggagacagcaugccugggcaaaaguuacgcccaaauguggcagcuuauguauuuucauaggcgagaccugcgucucgcggcuaaugccaucuguucugcaguucccguggauugggucccaaccagcagaacuaccugguccauccacgcccaccaucaguggaugacaacggaagacauguuaucaguguggaaccgcguauggauugaggaaaaucccuggauggaggauaagacccacguuagcucuugggaagaggugccuuaccugggcaaacgggaggaccaguggugcggguccuugauaggacugacugcuagggccacaugggcaaccaacauccaagucgcuauuaaucaggugagacgccucaucgguaacgaaaauuaucuugacuacaugacuaguaugaagcgguucaaaaacgagagcgauccagaaggcgcccugugguga

SEQ ID NO: 13346 - RNA, 9879 nt, Artificial Sequence
  derived and/or modified CDS sequence (opt3) from DENV-1__GQ868512__SS-prME
agcgugaccaugcugcucaugcuucugccaacagcauuggcuuuccacuuaacuacgagaggaggggaaccucauaugauagucuccaagcaggaaaggggaaaaucucuguuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuacaggauucuucaacgaggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaagaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaucgggcacguaugucagcgcaaucgcccaagcuaaggccucacaggaagggccucuuccggagauagaggacgaaguguuuaaaaagcgaaaccugacuaucauggauuugcacccaggauccgguaaaacccggcgcuaccuacccgcaauuguuagagaggcuaucaagaggaagcugcggacacucauuuuagccccuacccgaguggucgcgagugaaauggccgaggcacugaaaggcaugccaaucagauaucagacuacagcugugaagucugaacauaccgggcgcgagauaguagaccuuaugugccacgccacguucacuaugaggcugcucagccccgugcguguuccuaauuacaacaugauuaucauggaugaggcucauuuuacagacccggcauccaucgccgcccggggauauauuucaaccagagucggcaugggugaagcugcggcaaucuucaugaccgccacucccccagggucuguggaggcuuuuccucagagcaaugccgugauacaagaugaagagagggacauucccgaacgcaguuggaacuccggauacgauuggaucacagacuucccaggcaaaaccgucugguuuguaccuagcauuaagucuggcaaugauaucgcaaacuguuugagaaagaacgggaagagagugauacagcugucacggaagacauucgacacugaguaucagaaaacgaagaauaacgacugggauuacguugugaccacagacauuuccgagaugggagccaauuucagggcugaucgcgucaucgacccccguagaugccucaaaccagugauccugaaggaugguccggaacggguuauucuugcgggcccuaugcccgugacugucgccagugcagcucagaggcgcgggcgaaucggaagaaaccaaaauaaagagggcgaccaguacguguauaugggucagccacuaaacaaugaugaagaccacgcccauuggaccgaggcaaagaugcuguuggauaacauuaauacacccgaggggauaaucccugccuuauuugaaccagagcgggaaaagagcgcugccauugacggcgaguacaggcugcgcggagaagcgagaaaaaccuucguagagcucaugaggcggggcgaucugcccguguggcuuucguauaagguugcaucugagggguuucaguacuccgaccgucgcuggugcuucgauggagaacgaaacaaucaaguccuggaggaaaacauggacguggagaucuggacuaaagaaggugagagaaagaaacucaggccucggugguuggacgcccgcacguauagcgauccgcuggcucuaagagaguuuaaggaguucgccgcuggcaggcggucagugaguggggaccugauccucgagauuggaaaacuuccacagcaccugaccuuacgagcacagaaugccuuggauaaccuggucaugcuccacaauucugaacagggcgguaaggcuuacagacaugccauggaggaacugcccgacacaauagagacucuuaugcugcucgcauugaucgcgguucugaccgggggcgugacauuauuuuuccuauccggaaagggccuggggaaaaccagcauuggacuccuuuguguaacugccucaagugcucuguuguggauggccagcguggagccucacuggaucgcagcuuccauuauccuggaauuuuuccucaugguccugcuuauacccgagccagaucgccaaaggacaccucaggacaaccagcucgccuaugugguuaucggucuguuguuuaugauucugacgguggcagccaacgaaaugggcuuacuagagaccacuaagaaagaucuggggaucggacaugucgcugcggagaaucaccaacacgccacaaugcucgacguagaucuucggcccgcaucugcuuggacccuguacgccguggccaccacaguuauuacuccaaugaugcgucauacgaucgaaaacaccacagcaaauaucagcuugacugcuauugccaaccaggcggcuauccugaugggccucgacaaggguuggccuauuuccaaaauggauaucggggugccgcugcuugccuuaggcugcuacucacaggucaauccccugacccucacagcagccguguugaugcuggucgcucacuaugcaauaaucggaccaggccuacaggccaaggcgaccagagaggcucaaaagaggacugccgcagggauuaugaaaaacccuacgguggacggaaucguugccauugaucuggaccccgugguauacgacgcuaaguucgaaaaacagcucggccagaucaugcuucugauauuguguacaucucagauucugcucaugcgcaccacuugggcccugugcgagaguaucaccuuagcaacagguccacuuacuacccugugggaagggucgccuggaaaguuuuggaauacaacgaucgcugugagcauggccaacauuuuccggggcuccuaucucgcgggugccggccuagcauucucucugaugaaaucacuagggggaggccgaagagggaccggagcucaaggcgagacucugggugagaaguggaagaggcagcucaaucagcuuagcaaauccgaauuuaacacauacaagcgcagugggaucauggaggucgaucggucugaagccaaagagggacugaagagaggcgaaaccacuaaacaugcaguuagccgugguacagcuaaguugaggugguucguggagcggaaucuggucaagcccgagggcaaagugauagaccucggguguggacgcggcggguggucauauuacugcgccggauuaaagaaaguaaccgaagugaagggcuauacgaaaggugggccgggacacgaggaaccaauuccuauggccaccuacggcuggaaccugguuaaacuucauuccggcaaagauguguuuuucaugcccccagagaagugugacacacugcuaugcgauaucggggaaaguagccccaauccuacuauugaggagggacgaacccucagaguccugaagaugguggaaccgugguugagggguaaccaguuuuguaucaaaauacugaaucccuacaugccaucugucguggaggcgcucgaacaaaugcagcggaagcacggcgggaugcuuguucgcaacccucuguccagaaauucaacacacgagauguauuggguaagcugcggaacuggcaacaucgugucggcugucaacaugaccucuaggauguuacugaaucgauucacaauggcacaucggaaacccaccuacgagcgugacguggauuugggugccgggacuagacacguugcuguggaaccugaggucgccaaccucgacauuaucggacagcgcauugaaaauaucaagaacgagcauaaaaguacguggcacuaugaugaagacaauccauacaagacaugggcauaucacggcuccuacgaggugaagcccagcggcucagccuccucuaugguaaacggggugguuaggcugcuaaccaaaccuugggaugucauuccaauggugacucaaaucgcuaugaccgacacaacgcccuuuggacagcagcggguguucaaggagaaagucgacaccagaacuccgcgcgcgaagagggguacaacccagauaauggaaguuacugccaaauggcuuuggggcuuucugagccgaaauaagaagccucggauuuguacaagagaggaguucaccaggaaagugcgcaguaacgcagcuaucggggccguauuuguggaugagaaucaauggaacuccgcaaaggaagccgucgaggacgagcguuucugggaucucgugcaucgggaaagagagcugcacaaacagggaaagugcgcuacaugcguuuauaauaugaugggcaaaagggaaaagaaguugggugaguuugggaaagccaagggaagccgcgcgaucugguacauguggcugggcgcacgauuccucgaguucgaggcccuuggcuuuaugaacgaggaccauugguucucucgggaaaauucacugagugggguggagggagaagguuuacacaaacugggcuacauuuugagagauauauccaagaucccagggggaaacauguaugcugacgauacugccggcugggacaccaggauuacggaggaugaccuccagaaugaggcaaaaaucaccgaaauuauggagcccgaacaugcucugcuagccacaagcaucuuuaaacuuacuuaccagaacaaagucgugcgcguacaaagaccugcuaagaacgguaccguuauggaugugauaucucggagggaccagcgugggucgggacaggucggcacauauggccugaauacuuucaccaacauggaggugcagcucauccgacaaauggaaucagaggggauuuuucugccaagcgaguuggaaacgcccaauuuagccgagcgcgugcuggauuggcucgaaaagcacggagcagagagacuuaaacggauggcgaucuccggugacgacugugucguuaagccgauugaugacagguucgccacagcucugaccgcccuaaacgauaugggcaaagugcgcaaggacaucccucagugggaacccaguaaaggguggaaugauuggcagcagguaccauuuugcucucaccauuuccaccaacugauaaugaaggacggaagagagauuguggucccuugucggaaccaggaugagcucgugggcagggcacgaguuagccagggugcugggugguccuugcgugaaacugccugccugggaaagucauacgcacaaauguggcagcuuauguauuuucauagacgcgaccugcggcucgccgcgaaugcuaucuguagugccgugcccgucgauugggugccaacaucuaggaccacuuggagcauccacgcacaccaucaguggaugaccacagaggacauguuauccguauggaacagaguuuggauugaagagaaucccuggauggaagauaaaacgcacgugucaagcugggaggaggucccuuaccugggcaagcgcgaagaccaguggugcggcucuuugauagggcugaccgcccgggcuacuugggccacaaacauccaaguggcaauuaaucagguuaggcgacucaucggaaacgagaauuaucuugacuacaugaccuccaugaaaagauucaagaacgaaagugauccagagggugcucugugguga

SEQ ID NO: 13347 - RNA, 9879 nt, Artificial Sequence
  derived and/or modified CDS sequence (opt3) from DENV-1__GU131970__SS-prME
agcgugaccaugcugcucaugcuucugcccacagccuuggcuuuccacuuaacuacgagaggaggggagccucauaugaucgucuccaagcaggaaagaggaaaaucucuguuauuuaagaccucagccgguguuaauaugugcacacucauugccauggaccugggagagcuuugugaagauacuaugaccuacaaaugcccacagauaacagaggcggaaccggacgauguggacuguuggugcaaugcuaccgauacuuggguaacauaugggaccuguagucagacgggagagcaccggcgcgagaagcgaagcguggcccuggcaccccaugucggcuugggucucgaaacucguaccgagacauggauguccucugaaggggccuggaaacagauccagagaguggagacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgacuuuguggaggguuugagcggcgcgacuuggguugauguugugcuggaacacgggaguugugucacaaccauggcaaagaauaaacccacuuuggacaucgagcuccugaagacagaagugaccaacccugccauucuuagaaaacugugcaucgaggcuaagauauccaauacgaccacagauucuagguguccaacucagggagaagccaccuugguggaggagcaggacgcaaacuucgucugccggcgcacauuuguugaucgaggcugggguaauggguguggacucuucggcaaaggcagccuguuaacuugcgcuaaguuuaagugcgugaccaaacuggaagggaagauuguacaguacgagaaccucaaauauuccgugaucgucacagugcacaccggagaccaacaucagguugguaaugaaacuacggagcacggcacaauugccaccaucacuccccaggcgccuaccucagaaauccagcuuacagauuacggggcccugaccuuggacuguaguccaagaacuggacuagacuucaacgagauggugcugcucacaaugaaggagaaaagcuggcugguccauaagcaaugguuucuugaucugccguugcccuggacgucuggcgcauccaccucacaggaaacuuggaauaggcaggaccuccuggugacauucaaaaccgcucacgccaagaagcaagagguaguuguguuagguagccaggaaggggcuaugcacacagcccugacuggcgcaaccgagauucagacgaguggaaccacaacuauauuugccggccaucuaaaaugccggcucaagauggauaaacugacccuuaaggggacaucuuaugucauguguacuggauccuucaaauuggaaaaggagguggcugagacccagcacgguacgguccuggugcaaguuaaguacgaaggcacagacgcgccuugcaaaaucccauucagcacccaggaugagaagggggugacucagaacggacgucucauuacagcaaaucccaucguaaccgacaaagaaaagccugucaacauagagacugagccacccuuuggcgaaucguauauugugguuggugccggggagaaagcucugaaacuuucuugguucaagaaaggcuccucaaucggaaagauguuugaagccaccgcacgcggcgccagaaggauggcuauccugggggauacagccugggacuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugauagcggaugcguuauuaacuggaaaggccgagaguugaagugugguucugggaucuucgugaccaacgaagugcacacguggacagagcaguauaaguuucaggccgacucaccgaaacgccugagugcagccaucggaaaggcuugggaggaaggcguaugcgguauuagaagcgccaccaggcucgagaauauaauguggaaacagaucuccaacgaacugaaucauauuuuacuggagaacgauaugaaguucacugucgugguuggcgacgcaaaugggauccuugcucaaggcaagaagaccauucggccucagcccauggaacacaaauacucuuggaagucguggggcaaggccaaaaucauaggggcggacauccagaacacaacuuuuauuaucgauggaccagacaccccugagugucccgauaaucagcgcgccuggaacauuugggagguggaagacuauggcuucgguaucuuuacaacgaauauaugguugaagcucagagauagcuacacccaaaugugcgaccacaggcugauguccgcugcaauuaaagauucaaaggccguccaugcugacaugggguauuggaucgagagugagaagaaugagacuuggaagcuagcccgugcaucuuucauugaagugaagacauguaccuggccaaaaagccacacucugugguccaauggaguucucgagucagagaugaucauacccaagaucuacggcgguccuauuagccagcauaacuaucggccaggcuacuucacacagaccgcggggccguggcaccugggaaaacuugaauuggauuuugaccugugcgagggcacgacugugguagucgaugaacacugcgggaaucgaggacccucuuuaagaaccacaaccgugacuggcaagaucauucaugagugguguugcagguccuguacacucccuccacugcgcuuccggggugaggacgggugcugguacggaauggaaaucagacccgugaaagagaaggaagagaaccuugucaggaguaugguuagcgccggcucuggugaaguggauuccuuuucacugggcauauuguguguaaguauuaugaucgaggaggugaugcgcagccgauggucgcggaagaugcucaugaccgggacacuggcugucuuccuacugcucaucaugggacaacugacuuggaaagaccuuauucguuugugcaucauggugggcgccaaugcauccgacagaauggggaugggaaccacguaucuggcuuuaauggccacauuuaagaugaggccuauguucgcaguuggccuccuguuucgccggcuuaccucuagagaagugcugcuacucacuauuggucugagcuuggucgccucaguggagcugccaaacaguuuagaagaacucggggauggacuggcuaugggcauaaugaugcuuaaacuguugaccgaguuccacccccaucagcucuggacaacucugcuaucccugaccuuuaucaagacgacacuuucucucgacuacgcguggaaaaccacugccauggcacugagcauuguuuccuuguucccgcuguguuuaucaacaaccagccagaagacuacauggcucccugugcugcuuggcaguuuugggugcaagccacugaccauguucuugaucacggagaacaaaauuuggggaaggaagucuuggccccucaaugaggguaucauggcuauaggcaucgucuccauucugcuaagcucgcugcuuaaaaacgauguaccucucgccgggccccugaucgccggaggcauguugauugcuuguuaugugaucucagguucuagugcagacuuaucccuggaaaaggccgcggagguuagcugggaacaggaggcugaacacucugggacuagccauaauauacucguggagguccaagaugacggaaccaugaaaauuaaggaugaggaacgagacgauacacugaccauccuucugaaagccacauugcuagcaguguccggcguauacccaaugucaaucccugccacucuguuugugugguauuucuggcagaagaagaaacagcgcaguggcguccucugggacacccccagcccaccggagguugaacgggcugugcuggaugacgggauuuacagaauacuucagaggggauuacugggucguucucaagugggcgucgggguguuccaggauggaguuuuucacacgauguggcacguaacacgcggcgcagugcucauguaucaggguaagcgguuggagccuuccugggccucagucaaaaaggaccugaucaguuacgggggaggcuggagauuccagggcagcuggaacacuggggaggaagugcaaguuauugcgguggagcccggcaaaaauccaaagaacguccagaccacacccgguaccuuuaagacuccugaaggcgaggugggggcuaucgcccucgacuucaaaccaggaaccuccggcucucccauuguaaauagggaagguaagaucgucgggcuguacggaaacggcgugguuacaacgucgggcacuuaugugagcgcaauagcccaggcuaaagccucacaagaggggccucuuccggagaucgaagaugaggucuuuaagaaacgaaaucugaccauuauggacuugcauccaggauccgguaagacacggcgcuaccuacccgcaaucgugagagaagcuauuaagaggaaacugcggacccucaucuuagccccuacucgaguuguggcgagugagauggccgaagcacugaagggcaugccaauaagauaucagacaaccgcugucaaaucugagcacacggggcgcgagauuguggaucuuaugugccaugccacuuucacaaugaggcugcucagccccguacgugugccuaacuacaauaugaucaucauggacgaagcucacuuuaccgauccggcauccauugccgcccggggauauaucucaaccagaguuggcaugggugaggcugcggcaauauucaugacugccacacccccagggucugucgaggcuuuuccucagagcaacgccgugauucaggacgaagaaagggauauccccgagcgcaguuggaacuccggauacgacuggauuaccgauuucccaggcaagacagugugguuugucccuagcaucaaaucuggcaacgacauagcaaauuguuugcgaaagaacgggaagagaguaauucaacugucacggaaaacuuucgauacggaguaucagaagaccaaaaacaaugacugggacuacgugguuacaacugauaucuccgaaaugggagccaacuucagggcugaccgcgugaucgauccccguagaugccucaagccagucauucugaaagacgguccggagcgggugauccuugcgggcccuaugcccguuaccguggccagugcagcucagaggcgcgggcgaauuggaagaaaucagaacaaggaaggcgaucaauacgucuauaugggucagccacuaaauaacgacgaggaucaugcccacuggacagaggcaaagaugcuguuggacaauauaaacacccccgaagggaucauuccugccuuauuugagccagaacgggagaaaagcgcugccaucgauggcgaauacaggcugcgcggagaggcgagaaagacuuucguggagcucaugaggcggggcgaccugcccguauggcuuucguauaaaguggcaucugaaggguuucaguacuccgaucgucgcuggugcuucgacggagagcgaaauaaccagguucuggaagagaauauggaugucgaaaucuggacgaaggagggugagaggaaaaagcucaggccucggugguuggacgcccgcaccuauagcgacccgcuggcucuaagagaauuuaaagaguucgccgcuggcaggcggucagugaguggggaucugauucucgaaauaggaaaacuuccacaacaccugacauuacgagcacagaacgccuuggacaaucuggugaugcuccauaacucugagcagggcgguaaggcuuacagacacgccauggaagaacugcccgauacuaucgagacccuuaugcugcucgcauugauugcgguccugacagggggcguuaccuuauuuuuccuauccggaaaaggccuggggaagacuagcaucggacuccuuugugugacagccucaagugcucuguuguggauggccagcguagaaccucauuggauugcagcuuccaucauacuggaguuuuuccucauggugcugcuuauccccgaaccagaccgccagaggacgccucaagauaaucagcucgccuaugucgugauuggucuguuguuuaugauccugaccguugcagccaacgagaugggcuuacuagagacuaccaaaaaggaccuggggauuggacacguggcugcggaaaaccaccagcaugccaccaugcucgaugucgaccuucggcccgcaucugcuuggacccuguacgccguagccacaacugugaucacgccaaugaugcgucacaccauagagaauacaacugcaaacauuagcuugaccgcuaucgccaaucaagcggcuauucugaugggccucgauaaagguuggccuaucuccaagauggacauagggguuccgcugcuugccuuaggcugcuacucacaggugaacccccugacacucaccgcagccgucuugaugcugguggcucauuaugcaaucauuggaccaggccuacaggccaaggcgacuagagaagcucagaaaaggacggccgcagggaucaugaagaauccuacagucgauggaauuguggccaucgaccuggaucccguuguguacgacgcuaaauucgagaagcaacucggccagauaaugcuucugauuuuguguaccucucagauccugcucaugcgcacuaccugggcccugugcgaaaguaucacauuagcaacugguccacuuaccacacugugggaggggucgccuggaaaauuuuggaacacgaccauugcuguaagcauggccaauaucuuccggggcuccuaucucgcgggugccggccuagcauucucucugaugaagucacuagggggaggccgaagagggacuggagcucagggcgagacacugggugaaaaguggaaaaggcaacucaaccagcuuagcaaguccgaguuuaauaccuacaaacgcagugggauaauggaaguggaccggucugaggccaaggaaggacugaaaagaggcgagacuacaaagcacgcagucagccgugguaccgcuaaguugaggugguucguugagcggaaccuggugaaacccgaaggcaaggucauugaucucggguguggacgcggcggguggucauauuacugcgccggacugaaaaaggugacggagguaaaaggcuauaccaagggugggccgggacaugaggaaccaaucccuauggccacauacggcuggaaucuagugaaacuucacuccggcaaggacguauuuuucaugcccccagaaaagugugauacucugcuaugcgacauuggggagaguagccccaacccuaccaucgaggaaggacgaacacucagagugcugaaaauggucgagccgugguugagggguaaucaguuuuguauaaagauccugaaccccuacaugccaucuguggucgaaacucucgagcagaugcaacggaaacacggcgggaugcuugugcgcaauccucuguccagaaacucaacccaugagauguauuggguuagcugcggaacaggcaauauuguaucggcggugaacaugaccucuaggauguuacugaaccgauucacuauggcucaccggaagcccacguacgaacgugaugucgacuugggugcagggacaagacauguggccguugagccugaaguggcuaaucucgauaucauuggacagcgcaucgagaacauuaaaaaugaacacaagaguaccuggcacuaugacgaggauaacccauacaagacuugggccuaucauggcuccuacgaggucaaacccagcggcucagcauccucuauggugaaugggguagugaggcugcuaaccaagccuugggacguuaucccaauggucacacagauagccaugacggauaccacucccuuuggacaacagcggguguucaaagaaaagguggacacaagaaccccgcgcgcuaaaagggguacuacacagauuauggaggucaccgcgaaguggcuuuggggcuuucugagccgaaacaagaaaccucggaucuguacaagagaagaguucacuaggaagguucgcaguaaugccgcaaucggggcuguguuuguagacgaaaaccaguggaacuccgccaaagaggcaguggaggaugaacguuucugggaccucguccaccgggagagagaacugcauaagcaaggaaaaugcgcaacaugcguguauaacaugaugggcaagagggagaagaaauugggugaauuugggaaggcuaaaggaagccgcgccauuugguacauguggcugggcgcgcgauuccucgaguucgaggcacuuggcuuuaugaaugaagaucacugguucucucgggagaacucacugagugggguugaaggagaggguuuacauaagcugggcuacauauugagagacaucuccaaaauuccagggggaaauauguaugccgaugacacggcuggcugggauaccaggaucacagaggacgaucuccagaacgaagccaagauuacugacaucauggagcccgaacacgcacugcuagcuaccagcauauuuaaacuuacauaccagaauaaggugguccgcgugcagagaccugccaagaacgguacuguaauggauguuaucucucggagggaccaacgugggucgggacaggugggcaccuauggccugaacacguucacaaauauggagguccagcucauucgacagauggaaucagaggggaucuuucugccaagcgaguuggaaacccccaacuuagcugagcgcgugcuggauuggcucgaaaaacacggagccgagagacuuaagcggauggcaauuuccggugacgacuguguggucaaaccgaucgaugacagguucgcgacugcccugacagcucuaaaugauaugggcaagguucgcaaagacauaccucaaugggaacccaguaagggguggaacgauuggcaacaggugccauuuugcucucaucacuuccaucagcugauuaugaaggacggaagagagaucguagugccuugucggaaucaagaugagcucgucggcagggcccgagugagccagggugcagggugguccuugaaagaaaccgcuugccugggaaagucauacgcccagauguggcaacuuauguauuuucaccguagagaccugcgccucgcagccaacgcgaucuguagugcuguucccguggauugggucccaacuucucggaccacauggagcauucacgcccaucaccaguggaugacgaccgaggacauguuauccguguggaauaggguauggauagaagagaaccccuggauggaagauaaaacucauguuucaagcugggaggaggugccuuaccugggcaagagagaagaccaguggugcggcucuuugaucgggcugacagcacgcgccaccugggcuacuaauauucaggucgccaucaaccaagugcggaggcucauuggaaaugagaacuaucuugacuacaugacauccaugaaacgauucaagaaugaaagugauccagagggugcacugugguga

SEQ ID NO: 13348 - RNA, 9879 nt, Artificial Sequence
  derived and/or modified CDS sequence (opt3) from DENV-1__KF955427__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagccuggacuggcgcaaccgaaauucagacgaguggaaccacaacuauauuugccggccaucugaaauggcggcuaaagauggacaaacucacccugaaggggacaucuuaugucaugugcacuggauccuucaaacuugagaaggaaguggcugagacccagcacgguacgggcuugguccaagugaaguacgaggggacagaugcgccuuguaaaaucccauucagcgcacaggacgaaaagggaguuacccagaacggccgucugauuacugccaaucccaucgugacagauaaagagaagccuguaaacauagaaaccgagccacccuuuggugagucguauauugucgugggggcuggcgaaaaagcccucaagcugucuugguucaagaaaggauccucaaucggcaagauguuugaggcaacugcccgcggggcuagaaggauggccauccuuggagacaccgcaugggauuucgguaguauuggcgggguuuuuacaagcgugggaaaacugguccaucagguguucggcacggcguacgguguauuguuuuccggggugucuuggaccaugaagaucggcauuggaauacuccugacuugguuaggccugaauagccggucaacaagucuauccaugaccugcaucgcuguugggauggucacacucuaccugggagugauggugcaagccgacagcggcugugucauuaacuggaaaggucgagaacuuaagugcgggucuggaaucuucguuacuaacgaggugcacaccuggacggaacaguauaaguuucaggcagauucaccgaaacgcuugagugccgcuaucggcaaggccugggaggaggguguguguggcauuagaagcgcaacaaggcuggaaaauauaauguggaaacagaucuccaacgagcucaaucauauucuguuagaaaacgacaugaaguucaccguagucgugggggacgcuaauggaauccuggcccaaggcaaaaagaugauucggccucagcccauggagcacaaauacucuuggaagucgugggggaaggcgaaaaucauaggagccgauauccagaacacuaccuuuauuaucgacggcccagauacaccugaaugccccgacaaucagcgcgcuuggaacauuugggagguugaggauuaugguuucgggaucuuuacuaccaauauauggcuuaaguugagagacagcuacacacaaaugugugaucacaggcucauguccgcagccauuaaagacucaaaggcugugcaugccgauaugggauauuggaucgaaagugagaaaaacgaaacguggaagcuggcacgugcgucuuucauugaggucaagaccugcacuuggccaaaaagccacacacuaugguccaauggcgugcuggaaucagagaugaucauacccaagaucuacgguggcccuauuagccagcauaacuaucggccaggguacuucacccagacugccggaccguggcaccucggcaaacuggagcuugacuuugauuugugugaagggacaaccguugugguagacgagcacugcggaaaucgaggccccucucugagaacgacuaccgucacagguaagaucauucaugaauggugcuguagguccugcaccuuaccuccacuccgcuuccggggggaggauggauguugguacggcauggagaucagacccgugaaagaaaaggaggaaaaccuggugaggaguauggucagcgcugguucuggcgagguugacuccuuuucacuugggauacugugcgccaguauuaugaucgaagaggugaugcgcagccgauggucgcggaagauguugaugacuggaacacucgcaguauuccugcuacuggugaugggccaacucaccuggaaugaccugauccgucuuuguauuauggucggggcuaacgccuccgauagaaugggaaugggcacaacuuauuuggcacugauggccaccuuuaaaaugaggccuauguucgcuguggguuuacucuuucgccggcugacgucuagagagguucuucugcuaacaaucgggcucagccugguggcgucagucgaauugccaaacagucuggaggaauuaggagacggccucgccaugggcauuaugaugcugaagcuucugaccgaguuccagccccaccaguuguggacuacccuccugucccuaacauuuauaaaaacuacccugucucuugauuacgcauggaagacgacagcuauggcccucagcaucgugucccuguucccguugugccugucaaccacuagccagaaaacaaccugguuaccuguucuccuggggaguuuuggauguaagccacuuacuauguuccugauuacagaaaauaagaucugggguaggaaaucuuggcccuugaacgagggcauuauggccaucgggauaguguccauccuccugagcucgcuacugaagaaugacgucccucuucccgauccacucauugcuggaggcauccugauugcaugcuauguaaucucagguucuagugccgacuuguccuuagagaaagcggcugaaaugagcugggagcaagaagccgagcauucugggaccagccacaacauacugguggaaguucaggaugacggaccuaugaagauuaaagaugaggagcgagacgauacgcucacuauccugcuuaaggcaacccuguuggccguguccggcgucuaccccaugucaaucccaggcacacuauuugugugguauuucuggcagaaaaagaagcagcgcagugggguacugugggacaccccgagcccucccaaaguggaacgggcuguccucgaugacggaauuuacagaauacugcaaaggggucuuuuaggccguucucagguuggggugggaguguuccaggacggcgucuuucauacaauguggcacgugacucgcggugcaguucugauguaucaggggaagcggcucgagccauccugggccucaguaaaaaaggauuugaucaguuacggaggcggcuggagauuccaagggagcuggaauaccggagaagaggugcaggucauugcgguggagcccgguaaaaacccuaagaauguucagacgacaccaggcacuuuuaagacccccgaaggggaggugggagcuaucgcccuggacuucaaaccuggcacauccgguucuccgauugucaacagggaagggaagaucgugggacucuacggcaauggcguagucaccacuucggggaccuaugugagcgcaauagcccaagcuaaagccucacaggagggaccacugcccgaaaucgaggaugagguuuuuaagaaacgaaaccuuacaauuauggaccugcacccugguuccggcaagacgcggcgcuacuugccagcaaucgugagagaagcuauuaagaggaaacuacggacucugauccucgcccccacccgagucguggcgagugagauggccgaagcauuaaaggggaugccuauaagauaucagacaaccgcuguuaaaucugagcauacuggacgcgaaauuguggaucugaugugucacgccacauucaccaugaggcuucugagcccgguccgugugcccaauuacaacaugaucaucauggacgaggcucauuuuacggauccagcauccauugccgcccggggcuauaucucaacuagaguagguaugggggaggcugcggcaauauucaugacagccaccccucccggaucuguggaagcuuuuccacagagcaaugccguuauucaagacgaggaaagggauaucccugagcgcaguuggaacuccggcuacgacuggauuaccgauuuccccggcaagacugucugguuugugccaagcaucaaaucugggaaugacauagcaaacugccuccgaaagaacggaaagagagugauucaguugucacggaaaacauucgacaccgaauaucagaagacaaaaaauaacgauugggacuacgucguaacuacggauaucuccgagaugggugccaauuucagggcugaccgcgugaucgauccgcguagaugucugaagccuguuauucucaaagacggccccgagcgggugauccuggcggggccaaugcccgucaccguggccagugcagcucagaggcgcggacgaauuggcagaaaccaaaauaaggaaggugaucaguacguuuauauggggcagccucuuaacaaugacgaggaucacgcccauuggacagaagcaaagaugcuacuggacaacauaaauacuccagagggcaucauucccgccuuguuugagccugaacgggagaaaagcgcugccaucgauggagaauacagguuacgcggcgaggcgagaaagaccuucguggaacugaugaggcggggggaccucccggucuggcugucguauaaaguggcaucugagggauuucaguacuccgaucgucgcuggugcuucgacggugagcgaaacaaucaaguacuugaagagaacauggacguggaaaucuggacaaaggagggcgaaagaaaaaagcugaggccacgguggcucgaugcccgcaccuauagcgaccccuuggcucugagagaguuuaaagaguucgccgcugggaggcggucaauuaguggagaucuaauacuggaaaucggcaagcucccucagcaccuuacucugcgagcacagaaugccuuagacaacuugguuaugcugcacaauucugagcagggugggaaggcuuacagacaugccauggaagagcuccccgauacgauugaaacccugaugcuucuggcacucaucgcggucuugacaggcggagugacucuguuuuucuuauccggcaaagggcuaggaaagaccagcauuggucugcucugcgugacagccucaagugcucuucuguggauggccagcgucgagccacacuggaucgcagcuuccauaaucuuggaguuuuuccugaugguucuccugauuccugaacccgaccgccaaaggaccccacaggauaaccagcuugccuaugugguaaucggccuccuguuuaugauuuugacuguggcagccaacgagauggggcuguuagaaacaacgaaaaaggaccuaggaaucggccaugucgcugcggagaaucaccaacacgccaccaugcuggauguggaccuccggccugcaucugcuuggacucuuuacgccguugccacaaccgugauaaccccgaugaugcgucauacaauugagaacacuacggcaaauaucagccugaccgcuauugccaaccaggcggcuaucuugaugggucuggauaaaggguggcccauauccaagauggacaucggcgucccacuccuggcccuuggauguuacucacagguaaauccuuuaacacugacugcagccgugcucauguugguugcucacuaugcaauuaucggccccgggcugcaggccaaggcgaccagagaagcucaaaaaaggacagccgcaggaauuaugaagaacccaaccguggauggcaucgucgccauagaccuagacccuguggucuacgaugcuaaauucgagaagcagcugggucagauuaugcuccuuauccugugcacuucucagaucuugcugaugcgcacgacaugggcccucugugaaaguauuacccuggcaacugggcccuuaaccacacuuugggagggaucgccgggcaaauuuuggaauacuaccaucgcugugagcauggccaacauauuccgggguuccuaucuggcgggcgccgggcucgcauucucucuaaugaagucacugggaggcgggcgaagaggaacaggcgcucaaggugaaacguugggggagaaguggaaaaggcagcugaaucagcucagcaaguccgaguuuaacaccuacaaacgcaguggaauuauggaaguugaccggucugaggccaaggaaggccuuaaaagaggugagacuacaaagcaugcagugagccguggcaccgcuaagcugaggugguucguagaacggaauuuggugaaaccagaggggaaggucaucgaucugggaugcggccgcgggggauggucauauuacugugccggccucaaaaagguuacugaggugaaagguuauacaaaggggggaccuggccacgaagagcccauuccaauggccaccuacggcuggaacuuagucaaacugcauuccgggaaggacguguuuuucaugcccccugaaaagugcgauacgcuucugugugacaucggagagaguagcccgaaucccaccauagaagagggucgaacacuaagaguacucaaaaugguggagccauggcugaggggcaaccaguuuugcaucaagauuuugaauccuuacaugcccucuguuguggaaacucuggagcaaaugcagcggaaacacgggggaaugcucguccgcaacccucuuuccagaaauucaacccacgaaauguauugggugagcuguggcacagguaacaucgucucggcggugaacaugacuucuaggaugcuguuaaaucgauucaccauggcucaucggaagccaacauacgagcgugauguugaccugggggcaggaaccagacacguagccguggagcccgaagucgcuaacuuggauauuaucggccagcgcauugagaauaucaaaaacgaacauaagaguacuuggcacuaugacgaggauaauccuuacaagacgugggccuaucacggcuccuacgaagugaaaccaagcgggucagcauccucuaugguuaacggaguggucaggcuccugacaaagcccugggacgugauaccgaugguaacccaaauugccaugacugacaccacaccuuuuggucagcagcggguguucaaagagaagguugauacgagaaccccacgcgcuaaaaggggcacuacacagaucauggaggucaccgcgaaguggcuauggggguuucuuagccgaaauaagaaaccccggaucugcacuagagaagaguucacaaggaaggugcgcaguaacgccgcaauuggagcuguguuugucgacgaaaaucaauggaacuccgccaaagaggcaguugaagaugagcguuucugggaccuggugcaucgggagagagaacuccacaagcagggcaaaugugccaccugcguauauaauaugauggguaagagggagaagaaacugggggaauuuggaaaggcuaaaggcagccgcgccauaugguacaugugguugggcgcgcgauuccuggaguucgaagcacucggguuuaugaacgaggaucauugguucucucgggagaauucacuuaguggaguggaaggugagggccugcacaaguuaggguacauccugagagacauuuccaaaaucccuggaggcaacauguaugccgaugacacagcugguugggauacuaggauuaccgaagacgauuugcagaaugaggccaagaucacggagauaauggaaccagagcaugcacuccuggcuaccagcaucuuuaaacuaacauaccagaacaaggucgugcgcguucaaagacccgccaagaacgggacugugauggacgucauuucucggagggaucagcguggaucgggccaggugggcaccuaugggcuuaauacauucacuaacauggaaguacagcugauccgacaaauggagucagaaggaauuuuucucccgagcgagcuggagaccccuaauuuggcugaacgcguuuuagacuggcuggagaaacacggugccgaaagacucaagcggauggcaaucuccggcgacgauugcguggucaaacccauagacgauagguucgcgacggcccuuacagcucugaacgacauggggaaggugcgcaaagauauuccacagugggagccuaguaagggauggaaugacuggcagcaggugcccuuuuguucucaccauuuccaccaacuaaucaugaaggauggcagagaaaucgucguuccaugccggaaccaggacgagcugguggguagggcccgaguaagccagggggcaggauggucccuccgugagaccgcuuguuugggcaaaucauacgcccaaauguggcagcugauguauuuucauagacgcgaucuucggcuggcagccaaugcgauuugcagugcugugcccgucgacugggugccuacuucuaggacaaccuggagcauacacgcccaccaucaguggaugacuaccgaagauaugcucuccguuuggaacagaguguggaucgaggaaaauccauggauggaggacaagacacacgucucaagcugggaagaggugccguacuuaggcaaacgcgaggaccaguggugugggucucugauuggauugacggcacgggccaccugggcuacuaacauccaaguagccauuaaucagguuaggcgacugaucgguaacgaaaauuaucucgauuacaugacauccaugaagagauucaaaaacgagagugaccccgaaggcgcacuuugguga

SEQ ID NO: 13349 - RNA, 9879 nt, Artificial Sequence
  derived and/or modified CDS sequence (opt3) from DENV-1__GQ868513__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugccuacagcccugacuggcgcaaccgaaauucagacgaguggaaccacaacuauauuugccggccaccuaaaaugccggcucaagauggacaaacugacccuuaaggggacaucuuaugucauguguacuggauccuucaaauuggagaaggaaguggcugagacccagcaugguacgguccuggugcaaguuaaguacgagggcacagaugcgccaugcaaaauccccuucagcacccaggacgaaaagggggugacucagaacggacgucucauuacagcaaauccuaucguaaccgauaaagagaagccagucaacauagaaacugagcccccguuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaccagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcauacguggacagaacaguauaaguuucaggccgauucaccuaaacgccugagugcagccaucggaaaggcuugggaggagggcguaugcgguauuagaagcgccaccaggcucgaaaauauaauguggaaacagaucuccaacgagcugaaucacauuuuacuggaaaacgacaugaaguucacugucgugguuggcgacgcaaaugggauccuugcucaaggaaaaaagaugauucggccccagccaauggagcauaaauacucuuggaagucguggggcaaggccaaaaucauaggggcggauauccagaacaccacauuuauuaucgacggaccugauacucccgaauguccagacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccacgcugauaugggguauuggaucgaaagugagaaaaacgaaaccuggaagcuagcccgugcaucuuucauugaggugaagacuuguacauggcccaaaagccauacccugugguccaauggaguucucgaaucagagaugaucauaccuaagaucuacggcgguccaauuagccagcacaacuaucggccgggcuacuucacucagacagcggggcccuggcaucugggaaaacuugaguuggacuuugaucugugcgaaggcaccacggugguagucgacgagcacugcgggaaucgaggaccuucuuuaagaacuaccacagugaccggcaagaucauucacgaaugguguugcagguccuguacucucccaccccugcgcuuccggggugaggaugggugcugguacggaauggagaucagaccugugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccaauguucgccguuggccuccuguuucgccggcuuacaucuagagaggugcugcuacucaccaucggucugagcuuggucgcuucaguggaacugcccaacaguuuagaggaacucggggacggacuggcgaugggcauuaugaugcuuaagcuguugacugaguuccagccgcaucagcucuggauaacccugcuaucccugacauuuaucaaaacuacccuuucucucgauuacgccuggaagacgacagcaauggcucugagcauuguuuccuuguucccucuguguuuaucaaccacuagccagaaaacaaccuggcucccagugcugcuuggcaguuuugggugcaagccccugacuauguucuugaucacagaaaauaagauuuggggaaggaaaucuuggccucucaacgaggguaucauggccauaggcaucgucuccauucugcuaagcucgcugcuuaagaaugacguaccccucgccgggccacugaucgcuggaggcauguugauugcauguuaugugaucucagguucuagugccgauuuaucccuggagaaagcggcugaaguuagcugggagcaagaagccgagcacucugggaccagccauaacauacucguggaaguccaggacgauggaacgaugaagauuaaagacgaggagcgagaugacacucugaccauccuucugaaggcaacauugcuagccguguccggcguauacccuaugucaauccccgcuacccuguuugugugguauuucuggcagaaaaagaagcagcgcaguggcguccucugggauacaccaagcccgccugaaguugagcgggcagugcuggacgaugggauuuacagaauacuucaaaggggauuacugggucguucucaggugggcgucgggguguuccaggacggaguuuuucacacuauguggcauguaacccgcggcgccgugcucauguaucaggguaaacgguuggaacccuccugggcgucagucaagaaagaccugaucaguuacgggggaggcuggagauuccaaggcagcuggaauacgggggaggaggugcagguuauugcuguggaaccaggaaagaaccccaaaaauguccagacaaugccugguacuuuuaagaccccagagggcgaagugggggccaucgcacucgauuucaagcccggaacauccggcucuccuauuguaaacagggaggguaaaaucgucgggcuguacggaaauggcgugguuaccacuucgggcaccuaugugagcgccauagcucaagccaaggcaucacaggaagggccgcuuccagagaucgaggacgaagucuuuaaaaagcgaaaccugacaauuauggauuugcaccccggauccgguaaaacgcggcgcuaccuaccugcuauggugagagaggccaucaagaggaagcugcggacucucauuuuagcgccaacccgaguuguggccagugaaauggcagaggcucugaaaggcaugcccaucagauaucagacaaccgccgucaagucugaacacacugggcgcgagauaguggaccuuaugugccaugcuacauucaccaugaggcugcucagcccuguacgugugccgaauuacaacaugauuaucauggaugaggcacacuuuacggaccccgccuccaucgccgcucggggauauauuucaacuagaguuggcaugggugaagcggcagccaucuucaugacagcuaccccaccugggucugucgaggccuuuccccagagcaaugcagugauacaagaugaagagagggacauuccagaacgcaguuggaacuccggauacgauuggaucaccgacuucccuggcaaaacugugugguuuguccccagcauuaagucuggcaaugauaucgccaacuguuugcgaaaaaacgggaagagaguaauacagcugucacggaagacauucgacaccgaguaucagaaaacaaagaauaacgacugggauuacgugguuacuacggacauuuccgagaugggagcuaauuucagggcggaucgcgugaucgacccacguagaugccucaaaccggucauccugaaggaugguccugaacgggugauucuugccggccccaugccaguuaccguggcaagugcugcccagaggcgcgggcgaaucggaagaaaccaaaauaaagagggcgaccaguacgucuauaugggucagccccuaaacaaugaugaagaccaugcacacuggacagaggccaagaugcuguuggauaacauuaauacuccugaggggauaaucccagcuuuauuugaacccgagcgggaaaagagcgccgcgauugacggcgaguacaggcugcgcggagaagcaagaaaaaccuucguggagcucaugaggcggggcgaucugccuguauggcuuucguauaagguggccucugagggguuucaguacuccgaccgucgcuggugcuucgauggagaacgaaacaaucaaguucuggaggaaaacauggacgucgagaucuggacaaaagaaggugagagaaagaaacucaggccgcggugguuggacgcucgcaccuauagcgauccacuggcccuaagagaguuuaaggaauucgcugcaggcaggcggucagugaguggggaccugauccucgagauuggaaaacuuccccagcaucugacuuuacgagcccagaaugcuuuggauaaccuggugaugcuccacaauucugaacagggcgguaaggccuacagacacgcaauggaggaacugccugacacgauagagacccuuaugcugcucgcguugaucgccguccugacagggggcguuacuuuauuuuuccuauccggaaagggccuggggaaaaccagcauuggacuccuuugugugacagcuucaagugcccuguuguggauggcaagcguagagccccauuggaucgcugccuccauuauccuggaauuuuuccucauggugcugcuuauaccagagccugaucgccaaaggaccccccaggacaaccagcucgcauaugucgugaucggucuguuguuuaugauucugacuguugccgcuaacgaaaugggcuuacuagagacaacgaagaaagaucuggggaucggacacguggcggccgagaaucaucaacacgcaaccaugcucgacgucgaucuucggccagcuucugccuggacucuguacgccguagcaacaaccgugauuaccccuaugaugcgucacacaaucgaaaacacuacggcuaauauaagcuugaccgccauugcgaaccaggcugccauccugaugggccucgacaaggguuggccgauuuccaaaauggauaucgggguuccccugcuugcauuaggcugcuacucacaggugaauccacugacacucacugccgcugucuugaugcugguggcacauuaugccauaaucggaccuggccuacaggcgaaggcuaccagagaggcccaaaagaggacagcagccgggauuaugaaaaaccccaccgucgacggaaucguggcuauugaucuggacccaguuguguacgacgccaaguucgaaaaacagcucggccagaucaugcuucugauauuguguacuucucagauucugcucaugcgcacgacaugggcacugugcgagaguaucaccuuagcuacugguccucuuaccacacugugggaagggucgcccggaaaguuuuggaauacuaccaucgccguaagcauggcgaacauuuuccggggcuccuaucucgccggugcaggccuagcuuucucucugaugaaaucauuggggggaggccgaagagggacaggagcccaaggcgagacgcugggugagaaguggaagaggcagcucaaucagcuuagcaaauccgaauuuaacaccuacaagcgcagugggaucauggagguggaucggucugaagcaaaagagggacugaagagaggcgaaacuacaaaacacgcugucagccgugguaccgccaaguugaggugguucguugagcggaaucuggugaagccggagggcaaagucauagaccucggguguggacgcggcggguggucauauuacugcgccggauuaaagaaagugacugaaguaaagggcuauacaaaaggugggccaggacaugaggaaccuauucccauggcgaccuacggcuggaaccuggugaagcuucacuccggcaaagauguuuuuuucaugccacccgagaagugugacacgcugcuaugcgauaucggggaaaguagcccuaauccgaccauugaggagggacgaacacucagagugcugaagauggucgaacccugguugagggguaaccaguuuuguaucaaaauacugaauccauacaugccuucuguggucgagacucucgaacaaaugcagcggaagcauggcgggaugcuugugcgcaacccccuguccagaaauucaacccacgagauguauuggguuagcugcggaacaggcaacaucguaucggcugugaacaugacuucuaggauguuacugaaucgauucaccauggcacaccggaaaccuacauacgagcgugacgucgauuugggugccgggaccagacauguggcuguugaaccagagguggccaaccucgacauuaucggacagcgcauugaaaauaucaagaacgagcacaaaaguacuuggcauuaugaugaagacaaucccuacaagacgugggcauaucacggcuccuacgaggucaagccuagcggcucagccuccucuauggugaacgggguagugaggcugcuaacaaaaccaugggauguuauucccauggucacccaaaucgcuaugacugacaccacaccguuuggacagcagcggguguucaaggagaaaguggacacgagaaccccucgcgcgaagagggguacuacacagauaauggaagucaccgccaaauggcuuuggggcuuucugagccgaaauaagaagccacggauuuguacuagagaggaauucacaaggaaaguucgcaguaacgcagcuaucggggccguguuuguagaugagaaucaauggaacuccgcaaaggaagccguggaggacgagcguuucugggaucucguccaccgggaaagagagcugcauaaacagggaaagugcgcuaccugcguguauaauaugaugggcaaaagggaaaagaaguugggugaguuugggaaagccaagggaagccgcgcgaucugguacauguggcugggcgcacgauuccucgaauucgaggcccuuggcuuuaugaacgaggaccacugguucucucgggaaaauucacugagugggguugagggagaagguuuacauaaacugggcuacauuuugagagauauauccaagauccccgggggaaacauguaugcugacgauacagccggcugggacacuaggauuaccgaggaugaccuccagaaugaggcaaaaaucacggaaauuauggagccugaacacgcucugcuagccaccagcaucuuuaagcuuacauaccagaacaaagugguccgcgugcaaagaccagcuaagaacgguacuguaauggauguuauaucucggagggaccagcgugggucgggacaggugggcaccuauggccugaauacauucacuaacauggagguccagcucauccgacaaauggaaucagaggggauuuuucugcccagcgaguuggaaaccccgaauuuagccgagcgcgugcuggauuggcucgaaaagcauggagcagagagacuuaaacggauggcgaucuccggugacgacuguguggucaagccuauugaugacagguucgccacggcucugacagcccuaaacgauaugggcaaaguucgcaaggacaucccccagugggaaccaaguaaaggguggaaugauuggcagcaggugccuuuuugcucucaccacuuccaucaacugauaaugaaggacggaagagagauuguagugcccugucggaaccaggaugagcucgucggcagggcacgagugagccagggugcugggugguccuugcgugaaaccgccugccugggaaagucauacgcacaaauguggcagcuuauguauuuucacagacgcgaccugcggcucgccgcgaaugcuaucuguagugccguuccaguggauuggguccccacuucuaggacaaccuggagcauccaugcacaccaccaguggaugacuaccgaggacauguuauccguguggaacagaguauggauugaagagaauccuuggauggaagauaaaacacauguuucaagcugggaggaggugccauaccugggcaagcgcgaagaccaguggugcggcucuuugauagggcugacggcccgggcuaccugggccacuaacauccaagucgcaauuaaucaggugaggcgacucaucggaaacgagaauuaucuugacuacaugacauccaugaaaagauucaagaacgaaagugauccggagggugcucugugguga

SEQ ID NO: 13350 - RNA, 9879 nt, Artificial Sequence
  derived and/or modified CDS sequence (opt3) from DENV-1__GU131973__SS-prME
agcgugaccaugcugcucaugcuucugccaacagccuuggcuuuccacuuaacuacgagaggaggggaaccucauaugaucgucuccaagcaggaaaggggaaaaucucugcuguuuaagaccucagcugguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuacaggauucuucaacgaggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaaaaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaucgggcacguaugucagcgcaaucgcccaagcuaaggccucacaggaagggccucuuccggagauagaggacgaaguguuuaaaaagcgaaaccugacuaucauggauuugcacccaggauccgguaaaacccggcgcuaccuacccgcaauuguuagagaggcuaucaagaggaagaugcggacacugauucucgccccuacccgaguggucgcgagugaaauggccgaggcauuaaaaggcaugccaaucagauaucagacuacagcugugaagucugaacauaccgggcgcgagauaguagaccugaugugccacgccacguucacuaugaggcuucugagccccgugcguguuccuaauuacaacaugauuaucauggaugaggcucauuuuacagacccggcauccaucgccgcccggggauauauuucaaccagagucggcaugggugaagcugcggcaaucuucaugaccgccacucccccagggucuguggaggcuuuuccucagagcaaugccgugauacaagaugaagagagggacauucccgaacgcaguuggaacuccggauacgauuggaucacagacuucccaggcaaaaccgucugguuuguaccuagcauuaagucuggcaaugauaucgcaaacugucucagaaagaacgggaaaagagugauacaguugucacggaagacauucgacacugaguaucagaaaacgaagaauaacgacugggauuacguugugaccacagacauuuccgagaugggagccaauuucagggcugaucgcgucaucgacccccguagaugccugaaaccagugauccucaaggaugguccggaacggguuauucuggcgggcccuaugcccgugacugucgccagugcagcucagaggcgcgggcgaaucggaagaaaccaaaauaaagagggcgaccaguacguguauaugggucagccacuuaacaaugaugaagaccacgcccauuggaccgaggcaaagaugcuacuggauaacauuaauacacccgaggggauaaucccugccuuguuugaaccagagcgggaaaagagcgcugccauugacggcgaguacagguuacgcggagaagcgagaaaaaccuucguagagcugaugaggcggggcgaucuccccguguggcugucguauaagguugcaucugagggguuucaguacuccgaccgucgcuggugcuucgauggagaacgaaacaaucaaguccuugaggaaaacauggacguggagaucuggacuaaagaaggugagagaaagaaacugaggccucgguggcucgacgcccgcacguauagcgauccguuggcucugagagaguuuaaggaguucgccgcuggcaggcggucagugaguggggaccuaauccuggagauuggaaaacucccacagcaccuuacccugcgagcacagaaugccuuagauaacuuggucaugcugcacaauucugaacagggcgguaaggcuuacagacaugccauggaggaacuccccgacacaauagagacucugaugcuucuggcacucaucgcgguuuugaccgggggcgugacacuguuuuucuuauccggaaagggccuagggaaaaccagcauuggacugcucuguguaacugccucaagugcacuucuguggauggccagcguggagccucacuggaucgcagcuuccauuaucuuggaauuuuuccugaugguccuccugauacccgagccagaucgccaaaggacaccucaggacaaccagcuugccuaugugguuaucggucuccuguuuaugauuuugacgguggcagccaacgaaaugggccuguuagagaccacuaagaaagaucuagggaucggacaugucgcugcggagaaucaccaacacgccacaaugcuggacguagaucuccggcccgcaucugcuuggacccuuuacgccguggccaccacaguuauuacuccaaugaugcgucauacgaucgaaaacaccacagcaaauauaagccugacugcuauugccaaccaggcggcuaucuugaugggccuggacaaggguuggccuauuuccaaaauggauaucggggugccgcuccuggcccuuggcugcuacucacaggucaaucccuuaacccugacagcagccgugcucauguuggucgcucacuaugcaauaaucggaccaggccugcaggccaaggcgaccagagaggcucaaaagaggacugccgcagggauuaugaaaaacccuacgguggacggaaucguugccauugaucuagaccccgugguauacgacgcuaaguucgaaaaacagcugggccagaucaugcuccuuauacuguguacaucucagauuuugcugaugcgcaccacuugggcccucugcgagaguaucacccuggcaacagguccauuaacuacccuuugggaagggucgccuggaaaguuuuggaauacaacgaucgcugugagcauggccaacauuuuccggggcuccuaucuggcgggugccggccucgcauucucucuaaugaaaucacuagggggaggccgaagagggaccggagcucaaggcgagacuuugggugagaaguggaagaggcagcugaaucagcucagcaaauccgaauuuaacacauacaagcgcagugggaucauggaggucgaucggucugaagccaaagagggacuuaagagaggcgaaaccacuaaacaugcaguuagccgugguacagcuaagcugaggugguucguggagcggaauuuggucaagcccgagggcaaagugauagaccugggguguggacgcggcggguggucauauuacugcgccggacucaagaaaguaaccgaagugaagggcuauacgaaaggugggccgggacacgaggaaccaauuccuauggccaccuacggcuggaacuuaguuaagcugcauuccggcaaagauguguuuuucaugcccccagagaagugugacacacuucugugcgauaucggggaaaguagccccaauccuacuauugaggagggacgaacccuaagaguccucaagaugguggaaccguggcugagggguaaccaguuuuguaucaaaauauugaaucccuacaugccaucugucguggaggcgcuggaacaaaugcagcggaagcacggcgggaugcucguucgcaacccucuuuccagaaauucaacacacgagauguauuggguaagcugcggaacuggcaacaucgugucggcugucaacaugaccucuaggaugcuguuaaaucgauucacaauggcacaucggaaacccaccuacgagcgugacguggaucugggugccgggacuagacacguugcuguggaaccugaggucgccaacuuggacauuaucggacagcgcauugaaaauaucaagaacgagcauaaaaguacguggcacuaugaugaagacaauccauacaagacaugggcauaucacggcuccuacgaggugaagcccagcggcucagccuccucuaugguaaacggggugguuaggcuccugaccaaaccuugggaugucauuccaauggugacucaaaucgcuaugaccgacacaacgcccuuuggacagcagcggguguucaaggagaaagucgacaccagaacuccgcgcgcgaagagggguacaacccagauaauggaaguuacugccaaauggcuauggggcuuucuuagccgaaauaagaagccucggauuuguacaagagaggaguucaccaggaaagugcgcaguaacgcagcuaucggggccguauuuguggaugagaaucaauggaacuccgcaaaggaagccgucgaggacgagcguuucugggaucuggugcaucgggaaagagagcuccacaaacagggaaagugcgcuacaugcguuuauaauaugaugggcaaaagggaaaagaagcugggugaguuugggaaagccaagggaagccgcgcgaucugguacaugugguugggcgcacgauuccuggaguucgaggcccucggcuuuaugaacgaggaccauugguucucucgggaaaauucacuuagugggguggagggagaaggucugcacaaauuaggcuacauucugagagauauauccaagaucccagggggaaacauguaugcugacgauacugccggcugggacaccaggauuacggaggaugacuugcagaaugaggcaaaaaucaccgaaauuauggagcccgaacaugcucuccuggccacaagcaucuuuaagcuaacuuaccagaacaaagucgugcgcguacaaagaccugcuaagaacgguaccguuauggaugugauaucucggagggaccagcgugggucgggacaggucggcacauauggccuuaauacuuucaccaacauggaggugcagcugauccgacaaauggaaucagaggggauuuuucucccaagcgagcuggaaacgcccaauuuggccgagcgcguguuagauuggcuggaaaagcacggagcagagagacucaaacggauggcgaucuccggugacgacugugucguuaagccgauugaugacagguucgccacagcucuuaccgcccugaacgauaugggcaaagugcgcaaggacaucccucagugggaacccaguaaaggguggaaugauuggcagcagguaccauuuugcucucaccauuuccaccaacuaauaaugaaggacggaagagagauuguggucccuugucggaaccaggaugagcuggugggcagggcacgaguuagccagggugcuggguggucccuccgugaaacugccugcuugggaaagucauacgcacaaauguggcagcugauguauuuucauagacgcgaccuucggcuggccgcgaaugcuaucuguagugccgugcccgucgauugggugccaacaucuaggaccacuuggagcauccacgcacaccaucaguggaugaccacagaggacaugcucuccguauggaacagaguuuggauugaagagaaucccuggauggaagauaaaacgcacgugucaagcugggaggaggucccuuacuuaggcaagcgcgaagaccaguggugcggcucucugauaggguugaccgcccgggcuacuugggccacaaacauccaaguggcaauuaaucagguuaggcgacugaucggaaacgagaauuaucucgacuacaugaccuccaugaaaagauucaagaacgaaagugauccagagggugcucuuugguga

SEQ ID NO: 13351 - RNA, 9879 nt, Artificial Sequence
  derived and/or modified CDS sequence (opt3) from DENV-1__GQ868517__SS-prME
agcgugaccaugcugcucaugcuucugccaacagcauuggcuuuccacuuaacuacgcgaggcggggagccucauaugaucgucuccaagcaggaaaggggaaaaucucugcuguuuaagaccucagccgguguuaacaugugcacacucauugccauggaccugggcgagcuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauuccucacccaggacgaaaagggggugacucagaacggacgucugauuacagcaaaucccaucguaaccgauaaagagaagccugucaacauagaaacugagccacccuuuggcgagagcuauauugugguuggugccggggaaaaagcucuuaagcugucgugguucaagaaaggaucuuccaucggaaagauguuugaggccaccgcacgcggcgccagaaggauggcuaucuugggggacacagccugggauuucggaucaauugguggcguguuuacgagugucgggaaacucgugcaucagguauucggaaccgcauacggcgugcuguuuagcgguguuuccuggacuaugaagaucgggauuggcauauuacugacauggcuaggacucaauucucggagcaccucacugaguaugacauguaucgcggucggcauggugacucuuuacuugggggugaugguccaagcugacuccggaugcguuauuaacuggaaaggccgagaacugaagugugguagcgggaucuucgugaccaacgaggugcacacguggacagaacaguauaaguuucaggccgauucuccgaaacgccucucagcagccaucggaaaggcuugggaggagggcguaugcgguauuagaagugccaccaggcuggaaaauauaauguggaaacagaucagcaacgaguuaaaucauauucugcuugaaaacgacaugaaguucacugucgugguuggcgacgcaaaugggaucuuggcucaaggcaaaaagaugauucggccucagcccauggagcacaaauacuccuggaagucuuggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauauggcucaagcugagagacucguacacgcaaaugugcgaucacaggcuaaugagcgcugcaauuaaagacuccaaggccguccaugcugauaugggguauuggaucgaaucagagaaaaacgaaaccuggaagcuggcccgugcaaguuucauugaggugaagacuuguacauggccaaaaucucacacccucuggagcaauggaguucuggaauccgagaugaucauacccaagaucuacggcgguccuauuucacagcauaacuaucggccaggcuacuucacucagacagcggggccguggcaccuuggaaaauuggagcuggacuuugauuuaugcgaaggcaccacggugguagucgacgagcacugcgggaaucgaggacccagccucagaacuaccacagugaccggcaagaucauucaugaaugguguugcaggucuuguacucugccuccacuucgcuuccggggugaggaugggugcugguacggaauggagaucagacccgugaaagaaaaggaggaaaaccuggucagguccaugguuagugccggcagcggugagguggacucuuuuuccuugggcauacucugugcuucaauuaugaucgaagagguaaugcgcagucgauggagccggaagaugcugaugacagggacccuagccguguuccugcuccugaucaugggacaacuuacauggaaugacuugauucgucugugcaucauggucggcgcaaacgcuucggauagaauggggaugggaacuaccuauuuagcccucauggcaacguuuaaaaugaggccuauguucgccgugggccugcuuuuucgccggcugacauccagagagguucuacuccugaccauugguuugucucugguggcuagcgucgaauuaccaaacucacucgaggaacugggggacggacuugcgaugggcauaaugaugcugaaguugcucacugaguuccagccccaccagcuguggaccacacuacugagucuuacuuuuaucaaaaccacgcucucccuggauuacgccuggaagacaaccgcaaugguguugucuauuguuagccuguucccguuaugucucuccacuacaucacagaaaaccacuuggcugccugugcuucugggcagcuuugggugcaagccauugacaauguuccucaucaccgaaaauaagauuuggggaaggaaaaguuggccccugaacgaggguaucauggcuauaggcaucgucucuauucuacuguccagccuucucaagaaugacguaccucuggccgggcccuugaucgccggaggcauguuaauugcuuguuaugugaucucggguucaucugcagaucugagucucgagaaagccgcggaaguuuccugggagcaagaagcugagcauagcgggacgucucacaacauacugguggaaguccaggacgauggaacuaugaagauuaaagacgaggagcgagaugacacccuuacaauccuguugaaggccacccuacuggcagugagcggcguauacccaauguccaucccugccacacucuuugugugguauuucuggcagaaaaagaagcagcgcucaggcguccugugggauacucccaguccaccggaaguugagcgggcugugcuugacgaugggauuuacagaauauuacaaaggggacugcucggucguagccaggugggcgucgggguguuccaggacggaguuuuucauaccauguggcacguaacgcgcggcgcaguguugauguaucaggguaaacggcuggaaccuucuugggccuccgucaagaaagaccucaucucauacgggggaggcuggagauuccaaggcaguuggaauacaggggaggaggugcagguuauugcgguggaacccggaaagaaccccaaaaauguccagacuacccccgguacauuuaagaccccugagggcgaagugggggcuaucgcccuggauuucaagccaggaacuagcggcucccccauuguaaacagggaggguaaaaucgucgggcuuuacggaaauggcgugguuaccacaucuggcacguaugugucggcaauagcccaagcuaaggccagccaggaagggccucugccggagaucgaggacgaagucuuuaaaaagcgaaacuugacuauuauggaucuacacccaggaucagguaaaacccggcgcuaccugcccgcaaucgugagagaggcuauuaagaggaagcuccggacauuaauccuggccccuacccgaguuguggcguccgaaauggccgaggcacuuaaaggcaugccaauaagauaucagacuacagcugucaagagugaacauaccgggcgcgagauuguggaccugaugugccacgccacguucacuaugaggcucuugucucccguacgugugccuaauuacaacaugaucaucauggaugaggcucauuuuacagacccggcaagcauugccgcccggggauauaucuccaccagaguuggcaugggugaagcugcggcaauauucaugaccgccacucccccagggucagucgaggcuuuuccucagucuaaugccgugauucaagaugaagagagggacauccccgaacgcagcuggaacaguggauacgauuggauuacagacuucccaggcaaaaccgugugguuugucccuuccaucaagagcggcaaugauauagcaaacugucugcggaaaaacgggaagagaguaauucagcucucuagaaagacauucgacacugaguaucagaaaacgaagaauaacgacugggauuacgugguuaccacagacaucucagagaugggagccaauuucagggcugaucgcgugaucgacccccguagaugccugaaaccagucauucuuaaggaugguccggaacgggugauccuagcgggcccuaugcccguuacuguggccuccgcagcucagaggcgcgggcgaauuggaagaaaccaaaauaaagagggcgaccaguacgucuauaugggucagccacugaacaaugaugaagaccacgcccauuggaccgaggcaaagauguuguuagauaacauaaauacacccgaggggaucauuccugcccuguuugaaccagagcgggaaaagagugcugccaucgacggcgaguacaggcuccgcggagaagcgagaaaaaccuucguggagcugaugaggcggggcgaucuucccguauggcugagcuauaagguggcaucggagggguuucaguacucugaccgucgcuggugcuucgauggagaacgaaacaaucaaguucucgaggaaaacauggacgucgagaucuggacuaaagaaggugagagaaagaaauugaggccucgguggcuggacgcccgcacguauuccgauccgcuagcucugagagaguuuaaggaguucgccgcuggcaggcggagcgugucaggggaccucauucuugagauaggaaaacugccacagcacuuaaccuugcgagcacagaaugcccuggauaaccucgugaugcugcacaauagugaacagggcgguaaggcuuacagacaugccauggaggaacuucccgacacaaucgagacucugaugcucuuggcacugauugcggucuuaaccgggggcguuacacuauuuuuccugucuggaaagggccucgggaaaaccuccaucggacuucugugugugacugccagcucagcuuugcuguggauggccaguguagagccucacuggauugcagcuagcaucauacucgaauuuuuccugauggugcuucucauccccgagccagaucgccaaaggacaccucaggacaaccagcuggccuaugucgugauugguuugcuguuuaugaucuuaacgguugcagccaacgaaaugggccuacuggagaccacuaagaaagaucucgggauuggacauguggcugcggagaaucaccaacacgccacaaugcuugacgucgaucugcggcccgcauccgcuuggaccuuguacgccguagccaccacagugaucacuccaaugaugcgucauacgauagaaaacaccacagcaaauauuucucugacugcuaucgccaaccaggcggcuauucucaugggccuggacaaggguuggccuaucagcaaaauggauauagggguuccgcuuuuagcccugggcugcuacucccaggugaauccccucaccuugacagcagccguccugaugcuaguggcucacuaugcaaucauuggaccaggccugcaggccaaggcgaccagagaggcucaaaagaggacugccgcagggaucaugaaaaacccuacggucgacggaauuguggccaucgaucucgaccccguuguguacgacgcuaaguucgaaaaacagcuuggccagauaaugcuguugauucuguguacaucacagauccuccugaugcgcaccacuugggccuuaugcgagucuaucacccuugcaacagguccacugacuacccucugggaagggaguccuggaaaguuuuggaauacaacgauugcuguaucgauggccaacaucuuccggggcagcuaucuagcgggugccggccuggcauucuccuugaugaaaucucuagggggaggccgaagagggaccggagcucaaggcgagacucucggugagaaguggaagaggcagcuuaaucagcugucaaaaagcgaauuuaacacauacaagcgcuccgggauaauggagguggaucggagugaagccaaagagggauugaagagaggcgaaaccacuaaacaugcagucucucgugguacagcuaagcugaggugguucguugagcggaaucucgugaagcccgagggcaaagucauugacuuaggguguggacgcggcggguggagcuauuacugcgccggacugaagaaagugaccgaaguaaagggcuauacgaaaggugggccgggacacgaggaaccaaucccuauggccaccuacggcuggaaccuugugaagcugcauucaggcaaagauguauuuuucaugcccccagagaagugugacacacuacucugcgauauuggggaauccagucccaauccuacuaucgaggagggacgaacccugagaguguugaagauggucgaaccguggcugagggguaaccaguuuuguauaaaaauccucaaucccuacaugccaagcguggucgagacacuugaacaaaugcagcggaagcacggcgggaugcuggugcgcaacccuuuaucuagaaauuccacucacgagauguauuggguuucaugcggaaccggcaacauuguaagcgcggugaacaugacaucgaggaugcuguugaaucgauucaccauggcucaucggaaacccacuuuugagcgugacgucgaucucggugcagggacgagacacguggccguugaaccugagguggcuaaccuggacaucauuggacagcgcaucgaaaauauuaagaacgagcauaaaucuacauggcacuacgaugaagacaauccauauaagaccugggccuaccacggcaguuaugaggucaagcccuccggcagcgcaucauccauggugaacgggguagugaggcuacuuacuaaaccuugggauguuaucccaauggucacccaaauagccaugacagacacgacccccuucggacagcagcggguguuuaaggagaaaguggacacuagaacaccgcgcgcuaagagggguaccacucagauuauggaagucacagcgaaauggcuguggggcuuccucucucgaaauaagaagccucggaucuguaccagagaggaauuuacaaggaaaguucgcagcaacgccgcaaucggggcuguguucguagaugagaaucaauggaacagugccaaggaagcaguggaggacgagcguuuuugggaucugguccaucgggaaagagaguugcacaaacagggaaagugcgccacuugcguguacaauaugaugggcaaaagggaaaagaagcugggugaguucgggaaagcuaagggaucccgcgccauuugguauauguggcucggcgcgcgauuccuugaauuugaggcacugggcuucaugaacgaggaccauugguuuagccgggaaaauucuuuaucagggguugagggagaaggucugcacaaauugggcuacauacucagagauaucaguaagauuccagggggaaacauguacgccgacgauaccgcuggcugggacacgaggaucaccgaggaugaccugcagaaugaggccaaaauuacagauaucauggaacccgagcaugcacuacuugcuacuuccauauucaagcugaccuaucagaacaaagugguccgcgugcaaagaccugccaagaacgguacaguaauggacguuaucagccggagggaucagcgugggucuggacaggugggcacuuacggccucaauaccuuuacgaacauggaaguccagcugauucgacaaauggagucggaagggaucuucuugccaucagaguuagagacacccaaucuggcugaacgcgugcucgacuggcuugagaagcacggagccgaaagacugaaacggauggcaauuagcggugacgauuguguggucaagccgaucgacgauagguuugcgaccgcccuaacugcucugaacgacaugggcaaaguucgcaaggauauaccucagugggagcccuccaaaggguggaaugacuggcaacaggugccauucugcagucaccauuuucaccaacucauuaugaaggauggaagagaaaucguagugccuugucggaaccaggacgaguuggucggcagggcccgagugucucagggugcaggguggagccugcgugagacagcuugccuuggaaaguccuaugcccaaauguggcagcugauguacuuccauagacgcgaucuccgguuagcagccaaugcgaucuguucagcuguucccguggacugggucccaaccaguaggacuaccuggucuauucacgcccaccaucaguggaugacaacggaagauaugcugagcguguggaacagaguauggauagaggaaaaucccuggauggaggacaaaacccacguuuccucaugggaagaggugccuuauuugggcaagcgcgaggaccaguggugcggcagccugaucgggcucacugcacgggccacaugggcuaccaacauucaagucgccaucaaucaggugaggcgacuuauuggaaacgaaaauuaccuggauuauaugacuucuaugaaaagauuuaagaacgaguccgacccagaaggugcacuaugguga

SEQ ID NO: 13352 - RNA, 9879 nt, Artificial Sequence
  derived and/or modified CDS sequence (opt3) from DENV-1__GU131976__SS-prME
agcgugaccaugcugcucaugcuucugccaacagcauuggcuuuccacuuaacuacgagaggaggggagccucauaugaucgucuccaagcaggaaaggggaaaaucucugcuguuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuagucucaugauugaagagguaaugcgcagccgauggucgcggaagaugcugaugacagggacccuagccguguuccugcuccugaucaugggacaacuuacauggaaugacuugauccgucugugcauuauggucggcgcaaacgcuuccgauagaauggggaugggaacuaccuauuuagcccucauggcaacguuuaaaaugaggccuauguucgccgugggccugcuuuuucgccggcugacaucuagagagguucuacuccugaccaucgguuugagccugguggcuucagucgaauuaccaaacagucucgaggaacugggggacggacuugcgaugggcauuaugaugcugaaguugcucacugaguuccagccccaccagcuguggaccacacuacugucccuuacuuuuauaaaaaccacgcucucucuggauuacgccuggaagacaaccgcaauggcuuugagcaucgugucccuguucccguuaugucucucaacuacaagccagaaaaccacuuggcugccuguucuucugggcaguuuugggugcaagccauugacaauguuccucauuaccgaaaauaagaucuggggaaggaaaucuuggccccugaacgaggguauuauggccaucggcauaguguccauccuacugagcucgcuucucaagaaugacgucccucuggccgggcccuugauugcuggaggcauguuaaucgcauguuauguaauuucagguucuagugccgaucugucccucgagaaagcggcugaagugagcugggagcaagaagccgagcauucugggacgagccacaacauccugguugaagugcaggacgauggaacuaugaagauaaaagacgaggagcgagaugacacccuuacaauucuguugaaggcaacccuacuggccgucuccggcguguacccaaugucaaucccugcuacacucuuuguaugguauuucuggcagaaaaagaagcagcgcaguggcgugcugugggauacucccagcccaccggaagucgagcgggcaguucuugacgaugggaucuacagaauuuuacaaaggggacugcucggucguucucaggugggcgugggggucuuccaggacggaguguuucauaccauguggcacguuacgcgcggcgccguauugauguaucaggguaaacggcuggaaccuuccugggcgucagugaagaaagaccucauaaguuacgggggaggcuggagauuccaaggcagcuggaauacaggggaggagguccaggugaucgcuguugaacccggaaagaaccccaaaaaugugcagacuacccccgguacauuuaagaccccugagggcgaagucggggccauugcacuggauuucaagccaggaacuuccggcucucccaucgugaacagggaggguaaaauuguagggcuuuacggaaauggcgucgugaccacaucgggcacguauguuagcgccaucgcucaagccaaggcaucacaggaagggccucugccggagauagaggacgaaguguuuaaaaagcgaaacuugacuaucauggaucuacacccaggauccgguaaaacccggcgcuaccugcccgcuauugucagagaggccaucaagaggaagcuccggacauuaauucuggcgccuacccgagugguugccagugaaauggcagaggcucuuaaaggcaugccaaucagauaucagacuacagccgugaagucugaacauaccgggcgcgagauagucgaccugaugugccacgcuacguucacuaugaggcucuugagccccgugcguguaccuaauuacaacaugauuaucauggaugaggcacauuuuacagacccggccuccaucgccgcucggggauauauuucaaccagagugggcaugggugaagcggcagccaucuucaugaccgcuacucccccagggucuguugaggccuuuccucagagcaaugcagucauacaagaugaagagagggacauucccgaacgcaguuggaacuccggauacgauuggaucacagacuucccaggcaaaaccgugugguuugugccuagcauuaagucuggcaaugauaucgccaacugucugcggaaaaacgggaagagagucauacagcucucaagaaagacauucgacacugaguaucagaaaacgaagaauaacgacugggauuacguagugaccacagacauuuccgagaugggagcuaauuucagggcggaucgcguuaucgacccccguagaugccugaaaccagugauccuuaaggaugguccggaacgggucauucuagccggcccuaugcccgugacuguugcaagugcugcccagaggcgcgggcgaaucggaagaaaccaaaauaaagagggcgaccaguacguguauaugggucagccacugaacaaugaugaagaccacgcacauuggaccgaggccaagauguuguuagauaacauuaauacacccgaggggauaaucccugcucuguuugaaccagagcgggaaaagagcgccgcgauugacggcgaguacaggcuccgcggagaagcaagaaaaaccuucgucgagcugaugaggcggggcgaucuucccguguggcugucguauaagguagccucugagggguuucaguacuccgaccgucgcuggugcuucgauggagaacgaaacaaucaagugcucgaggaaaacauggacguugagaucuggacuaaagaaggugagagaaagaaauugaggccucgguggcuggacgcucgcacguauagcgauccgcuagcccugagagaguuuaaggaguucgcugcaggcaggcggucagucaguggggaccucauccuugagauuggaaaacugccacagcacuuaaccuugaaggcccagaaugcucuggauaaccucgugaugcugcacaauucugaacagggcgguaaggccuaccgacaugcaauggaggaacuucccgacacaauagagacucugaugcucuuggcgcugaucgccguguuaaccgggggcgucacacuauuuuuccuguccggaaaaggccucgggaagaccagcauuggacuucuguguguuacugcuucaagugccuugcuguggauggcaagcguggagccucacuggaucgcugccuccauuauccucgaauuuuuccugaugguacuucucauacccgagccagauagacaacgcacaccucaggacaaccagcuggcauauguggucaucgguuugcuguuuaugauuuuaacgguggccgcuaacgaaaugggccuacuggagaccacuaaaaaggaucucgggaucggacauguugcggccgagaaucaccaacacgcaacaaugcuugacguggaucugaggcccgcuucugccuggaccuuguacgccgucgcaaccacaguaauuacuccaaugaugcggcauacgaucgaaaacaccacagcuaauauaagccugacugccauugcgaaccaggcugccauccucaugggccuggacaaagguuggccuauuuccaagauggauaucggggugccgcuuuuagcacugggcugcuacucacagguuaauccccucaccuugacagccgcugugcugaugcuagucgcacacuaugccauaaucggaccaggccugcaggcgaaggcuacccgugaggcccaaaaacgaacugcagccgggauuaugaagaacccuacgguggacggaaucgucgcuauugaucucgaccccgugguuuacgacgccaaauucgaaaagcagcuuggccagaucaugcuguugauacuguguacaucucagauucuccugaugaggaccacuugggcauuaugcgagaguaucacccuugcuacagguccacugacuacccucugggaagggucgccuggaaaauuuuggaauacaacgaucgccgugagcauggcgaacauuuuccgcggcuccuaucuagccggugcaggccuggcuuucucuuugaugaagucacuagggggaggccggcgagggaccggagcccaaggcgagacucucggugagaaguggaaaagacagcuuaaucagcugagcaaguccgaauuuaacacauacaaaaggagugggaucauggagguagaucgcucugaagcaaaggagggauugaaacggggcgaaaccacuaagcaugcugugagcagagguacagccaagcugcguugguucgucgagaggaaucucguuaaacccgagggcaaggugauagacuuaggguguggacggggcggguggucauauuacugcgccggacugaaaaaggucaccgaagugaaaggcuauacgaagggugggccgggacacgaggaaccaauuccuauggcgaccuacggcuggaaccuuguaaaacugcauuccggcaaggauguguuuuucaugcccccagagaagugugacacacuacucugcgauaucggggaaaguagccccaauccuacuauugaggagggacgcacccugcgaguuuugaaaaugguggaaccguggcugagagguaaccaguuuuguaucaagauacucaaucccuacaugccaucugucguggagacacuugaacaaaugcagaggaaacacggcgggaugcugguccggaacccuuuaucccgcaauucaacucacgagauguauugggugagcugcggaaccggcaacaucguuucggcuguaaacaugacaucuagaaugcuguugaauagguucaccauggcacaucgaaagcccacuuuugagcgggacguggaucucggugccgggacgcgucacgucgcuguggaaccugagguugccaaccuggacauuaucggacagagaauugaaaauaucaaaaacgagcauaagaguacauggcacuacgaugaagacaauccauauaagaccugggcauaccacggcuccuaugaggugaaacccagcggcucagccuccucuauggucaacggggugguacgccuacuuacuaagccuugggaugugauuccaaugguuacccaaaucgcuaugacagacacgacccccuucggacagcagagggucuuuaaagagaagguggacacucggacaccgagagcgaaacgcgguaccacucagauaauggaagugacagccaaguggcuguggggcuuccucagcaggaauaagaaaccucgaauuuguacccgggaggaauuuacaagaaaggucaggaguaacgcagcuaucggggccguuuucguggaugagaaucaauggaacuccgcaaaagaagccguagaggacgagcgcuuuugggaucuggugcaucgugaacgggaguugcacaagcagggaaaaugcgcuacuugcgucuacaauaugaugggcaagagagaaaagaaacugggugaguucgggaaggccaaaggaagcagggcgaucugguauauguggcucggcgcacgcuuccuugaauuugaggcccugggcuucaugaacgaggaccauugguuuucucgagaaaauucauuaagugggguggagggagaaggucugcacaaguugggcuacauucuccgggauauauccaaaaucccagggggaaacauguacgcugacgauaccgccggcugggacacgagaauuaccgaggaugaccugcagaaugaggcaaagaucacagauauuauggaacccgagcaugcucuacuugccacuagcaucuucaaacugaccuaucagaacaagguugugaggguccaacgcccugcuaagaacgguacagugauggacguaauaucuagacgggaucagagggggucgggacagguuggcacuuacggccucaauaccuuuacgaacauggaagugcagcugauccgucaaauggagucagaagggauuuucuugccaagcgaguuagagacacccaaucuggccgaacgaguccucgacuggcuugagaaacacggaaccgaacgccugaagagaauggcaaucuccggugacgauuguguggugaaaccgauugacgaucgguuugcgacugcccuaacagcucugaacgacaugggcaaggucaggaaagauaucccucagugggagcccaguaagggguggaaugacuggcagcagguuccauucugcucucaccauuuucaccaacucauaaugaaggauggacgcgaaauugugguaccuuguagaaaccaggacgaguuggugggccgggccagggucagccagggugcaggguggucccugcgagagaccgcuugccuuggaaaaucauaugcccaaauguggcagcugauguacuuccaucguagagaucuccgcuuagcagccaaugcgaucuguagugcugugcccguugacugggugccaacuucucggaccacauggagcauccacgcccaccaucaguggaugacgaccgaagauaugcuguccgucuggaacaggguguggauugaggaaaaucccuggauggaggacaagacucacguaucaagcugggaagagguuccuuauuugggcaaaagagaggaccaguggugcggcucucugauagggcucacagcacgcgccaccugggcuacuaacauccaaguggccauuaaucagguccggaggcuuaucggaaacgaaaauuaccuggauuauaugacauccaugaagcgauuuaaaaacgagagugacccagaaggugcacuaugguga

SEQ ID NO: 13353 - RNA, 9879 nt, Artificial Sequence
  derived and/or modified CDS sequence (opt3) from DENV-1__GQ868518__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggaccacacugcuaucccugacuuuuauaaaaaccacgcuuucucucgauuacgccuggaagacaaccgcaauggcucugagcaucguuuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauuauggccaucggcauagucuccauccugcuaagcucgcugcuuaagaaugacguaccucucgccgggccccugauugcuggaggcauguugaucgcauguuaugugauuucagguucuagugccgauuuaucccuggagaaagcggcugaaguuagcugggagcaagaagccgagcauucugggccaagccacaacauccucguggaaguccaggacgauggaacgaugaagauaaaagacgaggagcgagaugacacucugaccauucuucugaaggcaacauugcuagccguguccggcguauacccuaugucaauccccgcuacccuguuugugugguauuucuggcagaaaaagaagcagcgcaguggcguccucugggauacaccaagcccgccugaaguugagcgggcagugcuggacgaugggaucuacagaauucuucaaaggggauuacugggucguucucaggugggcgucgggguguuccaggacggaguuuuucauacuauguggcacguaacccgcggcgccgugcucauguaucaggguaaacgguuggaacccuccugggcgucagucaagaaagaccugauaaguuacgggggaggcuggagauucaggggcagcuggaauacgggggaggaggugcaaguuaucgcuguggaaccaggaaagaaccccaaaaauguccagacaacuccugguaccuuuaagacaccagagggcgaagugggggccauugcacucgauuucaagcccggaaccuccggcucuccuaucguaaaccgagaggguaaaauugucgggcuguacggaaauggcgugguuacuaccucgggcacauaugugagcgccaucgcucaggccaaggcaucacaagaagggccgcuuccagagauagaggacgaagucuuuaaaaagcggaaccugacgaucauggauuugcaccccggauccgguaaaacucgcagauaccuaccugcuauugugagggaggccaucaagcggaagcugcgaacccucauuuuagcgccaacaagaguuguggccagugaaauggcagaggcucugaaaggcaugcccauccgcuaucagaccacugccgucaagucugaacauacagggagggagauaguggaccuuaugugccacgcuaccuucacgaugcgucugcucagcccuguacgggugccgaauuacaacaugauuaucauggaugaggcacauuuuacugaccccgccuccaucgccgcuagaggauauauuucaacaaggguuggcaugggugaagcggcagccaucuucaugaccgcuaccccaccugggucugucgaggccuuuccccagagcaaugcagugauacaggaugaagagcgcgacauuccagaacgaaguuggaacuccggauacgauuggaucacugacuucccuggcaaaacagugugguuuguccccagcauuaagucuggcaaugauaucgccaacuguuugagaaaaaacgggaagcggguaauacaacugucaaggaagaccuucgacacagaguaucagaaaacuaagaauaacgacugggauuacgugguuacgaccgacauuuccgagaugggagcuaauuuccgcgcggaucgugugaucgacccaagacggugccucaaaccggucauccugaaggaugguccugaaagggugauucuugccggccccaugccaguuacaguggcaagugcugcccagcgccgagggagaaucggacggaaccagaauaaagagggcgaccaauacgucuauaugggucagccccuaaacaaugaugaagaccacgcacauuggacugaggccaagaugcuguuggauaacauuaauaccccugaggggauaaucccagcuuuauuugaacccgagagggaaaagagcgccgcgauugacggcgaguaccgccugagaggagaagcaaggaaaacauucguggagcucaugcggcguggcgaucugccuguauggcuuucguauaagguggccucugagggguuucaguacuccgaccgccgauggugcuucgauggagaaagaaacaaucagguucuggaggaaaacauggacgucgagaucuggaccaaagaaggugagaggaagaaacuccggccgcgcugguuggacgcuagaacuuauagcgauccacuggcccuaagggaguuuaaggaauucgcugcaggccggcgaucagugaguggggaccugauccucgagauuggaaaacuuccccaacaccugacgucuagagcccagaaugcuuuagauaacuuggugaugcugcacaauuccgaacagggcgguaaggccuaccgccaugcaauggaggaacucccugacaccauagagacacugaugcuucuggcgcucaucgccgucuugacugggggcguuacccuguuuuucuuaagcggaaagggccuagggaaaacaucaauuggacugcucugugugaccgcuaguagcgcccuucuguggauggcauccguagagccccacuggaucgcugccucuauuaucuuggaauuuuuccugauggugcuccugauaccagagccugauaggcagcggacuccccaagacaaccagcuugcauaugucgugaucggucuccuguuuaugauuuugacaguugccgcuaacgaaaugggccuguuagagacgaccaagaaagaucuagggaucggacauguggcggccgagaaucaccagcacgcaacuaugcuggacgucgaucuccguccagcuagcgccuggacacuuuacgccguagcaaccaccgugauuacaccuaugaugagacauacuaucgaaaacacgaccgcuaauauaucccugacagccauugcgaaccaagcugccaucuugaugggccuggacaaggguuggccgauuucaaaaauggauaucgggguuccccuccuggcacuuggcugcuacucucaggugaauccauuaacucugaccgccgcuguccucauguugguggcacacuaugccauaaucggaccuggccugcaggcgaaggcuacaagggaggcccagaagcgcaccgcagccgggauuaugaaaaaccccacugucgacggaaucguggcuauugaucuagacccaguuguguacgacgccaaguucgaaaaacaacugggccagaucaugcuccuuauacuguguacgagucagauuuugcugaugcggacaaccugggcacucugcgagucgaucacucuggcuaccgguccuuuaacaacucuuugggaagggagccccggaaaguuuuggaauaccacaaucgccguauccauggcgaacauuuuccgaggcucuuaucuggccggugcaggccucgcuuucucacuaaugaaaagccuggggggaggcagaagggggacgggagcccagggcgagaccuugggugagaaguggaagcgccaacugaaucagcucuccaaaagugaauuuaacacuuacaagcggucugggaucauggagguggauagaagcgaagcaaaagagggacuuaagcguggcgaaacaaccaaacaugcugucucaagggguacugccaagcugcggugguucguugagcgcaauuuggugaagccggagggcaaagucauagaccugggguguggacgaggcgggugguccuauuacugcgccggacucaagaaagugacagaaguaaagggcuauaccaaaggugggccaggacacgaggaaccuauucccauggcgacguacggcuggaacuuagugaagcugcauaguggcaaagauguuuuuuucaugccacccgagaagugugacacccuucugugcgauaucggggaaagcucuccuaauccgacaauugaggagggaagaacucuaagggugcucaagauggucgaacccuggcugcgggguaaccaguuuuguaucaaaauauugaauccauacaugccuuccguggucgagacccuggaacagaugcaacgcaagcacggcgggaugcucgugagaaacccccuuucaaggaauagcacacacgagauguauuggguuucgugcggaacuggcaacaucguaucugcugugaacaugaccagucgaaugcuguuaaaucgguucacaauggcacaucguaaaccuaccuacgagagagacgucgaucugggugccgggacucgccacguggcuguugaaccagagguggccaacuuggacauuaucggacagaggauugaaaauaucaagaacgagcauaaauccacguggcacuaugaugaagacaaucccuacaagacaugggcauaucacggcagcuacgaggucaagccuucaggcuccgccucuagcauggugaacgggguagugcggcuccugaccaaaccaugggauguuauucccauggucacucagaucgcuaugaccgacacaacgccguuuggacaacagagaguguucaaggagaaaguggacacccgcacuccuagggcgaagcgagguacaacccagauaauggaagucacugccaaauggcuauggggcuuucuuagucggaauaagaagccaagaauuuguacaagggaggaauucacccgcaaaguucguuccaacgcagcuaucggggccguguuuguagaugagaaucaguggaacagcgcaaaggaagccguggaggacgagcgguucugggaucugguccauagagaaagggagcuccacaaacaaggaaagugcgcuacaugcguguauaauaugaugggcaaacgcgaaaagaagcugggugaguuugggaaagccaagggaucucgagcgaucugguacaugugguugggcgcacgguuccuggaauucgaggcccucggcuuuaugaacgaggaccauugguucucaagagaaaauagucuuuccgggguugagggagaaggucugcacaaauuaggcuacauucugagggauauaagcaagauccccgggggaaacauguaugcugacgauacugccggcugggacacccgcauuacggaggaugacuugcagaaugaggcaaaaaucaccgaaauuauggagccugaacaugcucuccuggccacaucuaucuuuaagcuaacuuaccagaacaaaguggucagagugcagcggccagcuaagaacgguaccguaauggauguuauaucgaggcgugaccaacgagggucaggacaggugggcacauauggccuuaauacuuucaccaacauggagguccagcugauccgccagauggaaagcgaggggauuuuucuccccuccgagcuggaaacgccgaauuuggccgagagaguguuagauuggcuggaaaagcacggagcagagcggcucaaaaggauggcgaucaguggugacgacuguguggucaagccuauugaugaccgcuucgccacagcucuuaccgcccugaacgauaugggcaaaguuagaaaggacaucccccaaugggaaccaucuaaaggguggaaugauuggcagcaggugccuuuuugcagccaccauuuccaccagcuaauaaugaaggacggacgggagauuguagugcccuguaggaaccaagaugagcuggucggccgagcacgugugucccagggugcuggguggucacucagagaaacugccugcuugggaaagaguuacgcacagauguggcaacugauguauuuucaucgccgggaccuuaggcuggccgcgaaugcuaucuguucugccguuccaguggauuggguccccacaagcagaaccacuugguccauccacgcacaccaucaguggaugaccacagaggacaugcucucaguguggaaccgcguauggauugaagagaauccuuggauggaagauaaaacgcacguuagcucuugggaggaggugccauacuuaggcaagcgggaagaccaguggugcggcucccugauaggguugaccgccagggcuacuugggccacaaacauccaggucgcaauuaaucaagugcgaagacugaucggaaacgagaauuaucucgacuacaugaccaguaugaaacgguucaagaacgaaagcgauccggagggugcucuuugguga

SEQ ID NO: 13354 - RNA, 9879 nt, Artificial Sequence
  derived and/or modified CDS sequence (opt3) from DENV-1__GQ868519__SS-prME
agcgugaccaugcugcucaugcuucugcccacugcauuggcuuuccacuuaacuacgcgaggcggggaaccucauaugaucgucuccaagcaggaaaggggaaaaucucugcuguuuaagaccucagccgguguuaacaugugcacccucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauuuucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauuccucacccaggacgaaaagggggugacucagaacggacgucugauuacagcaaaucccaucguaaccgauaaagagaagccugucaacauagaaacugagccacccuuuggcgagagcuauauugugguuggugccggggaaaaagcucuuaagcugucgugguucaagaaaggaucuuccaucggaaagauguuugaggccaccgcacgcggcgccagaaggauggcuaucuugggggacacagccugggauuucggaucaauugguggcguguuuacgagugucgggaaacucgugcaucagguauucggaaccgcauacggcgugcuguuuagcgguguuuccuggacuaugaagaucgggauuggcauauuacugacauggcuaggacucaauucucggagcaccucacugaguaugacauguaucgcggucggcauggugacucuuuacuugggggugaugguccaagcugacuccggaugcguuauuaacuggaaaggccgagaacugaagugugguagcgggaucuucgugaccaacgaggugcacacguggacagaacaguauaaguuucaggccgauucuccgaaacgccucucagcagccaucggaaaggcuugggaggagggcguaugcgguauuagaagugccaccaggcuggaaaauauaauguggaaacagaucagcaacgaguuaaaucauauucugcuugaaaacgacaugaaguucacugucgugguuggcgacgcaaaugggaucuuggcucaaggcaaaaagaugauucggccucagcccauggagcacaaauacuccuggaagucuuggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauauggcucaagcugagagacucguacacgcaaaugugcgaucacaggcuaaugagcgcugcaauuaaagacuccaaggccguccaugcugauaugggguauuggaucgaaucagagaaaaacgaaaccuggaagcuggcccgugcaaguuucauugaggugaagacuuguacauggccaaaaucucacacccucuggagcaauggaguucuggaauccgagaugaucauacccaagaucuacggcgguccuauuucacagcauaacuaucggccaggcuacuucacucagacagcggggccguggcaccuuggaaaauuggagcuggacuuugauuuaugcgaaggcaccacggugguagucgacgagcacugcgggaaucgaggacccagccucagaacuaccacagugaccggcaagaucauucaugaaugguguugcaggucuuguacucugccuccacuucgcuuccggggugaggaugggugcugguacggaauggagaucagacccgugaaagaaaaggaggaaaaccuggucagguccaugguuagugccggcagcggugagguggacucuuuuuccuugggcauacucugugcuucaauuaugaucgaagagguaaugcgcagucgauggagccggaagaugcugaugacagggacccuagccguguuccugcuccuggucaugggacaacuuacauggaaugacuugauccgucugugcauuauggugggcgcaaacgcuucggauagaauggggaugggaacuaccuauuuagcccucauggcaacguuuaaaaugaggccuauguucgccguuggccugcuuuuucgccggcugacauccagagaggugcuacuccugaccaucgguuugucucuggucgcuagcguggaauuaccaaacucacucgaggaacugggggacggacuugcgaugggcauuaugaugcugaaguugcucacugaguuccagccccaccagcuguggauaacccuacugagucuuacauuuaucaaaacuacccucucccuggauuacgccuggaagacgacagcaauggcuuugucuauuguuagccuguucccguuaugucucuccaccacuucacagaaaacaaccuggcugccugugcuucugggcagcuuugggugcaagccauugacuauguuccucaucacagaaaauaagauuuggggaaggaaaaguuggccccugaacgaggguaucauggccauaggcaucgucucuauucuacuguccagccuucucaagaaugacguaccucuggccgggcccuugaucgcuggaggcauguuaauugcauguuaugugaucucggguucaucugccgaucugagucucgagaaagcggcugaaguuuccugggagcaagaagccgagcauagcgggaccucucacaacauacugguggaaguccaggacgauggaacgaugaagauuaaagacgaggagcgagaugacacucuuaccauccuguugaaggcaacacuacuggccgugagcggcguauacccaauguccaucccugcuacccucuuugugugguauuucuggcagaaaaagaagcagcgcucaggcguccugugggauacacccaguccaccggaaguugagcgggcagugcuugacgaugggauuuacagaauauuacaaaggggacugcucggucguagccaggugggcgucgggguguuccaggacggaguuuuucauacuauguggcacguaacccgcggcgccguguugauguaucaggguaaacggcuggaaccuucuugggcguccgucaagaaagaccucaucucauacgggggaggcuggagauuccaaggcaguuggaauacgggggaggaggugcagguuauugcuguggaacccggaaagaaccccaaaaauguccagacaaugcccgguacuuuuaagaccccugagggcgaagugggggccaucgcacuggauuucaagccaggaacaagcggcucccccauuguaaacagggaggguaaaaucgucgggcuuuacggaaauggcgugguuaccacuucuggcaccuaugugucggccauagcucaagccaaggcaagccaggaagggccucugccggagaucgaggacgaagucuuuaaaaagcgaaacuugacaauuauggaucuacacccaggaucagguaaaacgcggcgcuaccugcccgcuauggugagagaggccaucaagaggaagcuccggacuuuaauucuggcgccuacccgaguuguggccuccgaaauggcagaggcucuuaaaggcaugccaaucagauaucagacaaccgccgucaagagugaacauacugggcgcgagauaguggaccugaugugccacgcuacauucaccaugaggcucuugucucccguacgugugccuaauuacaacaugauuaucauggaugaggcacauuuuacggacccggccagcaucgccgcucggggauauauuuccacuagaguuggcaugggugaagcggcagccaucuucaugacagcuacaccaccagggucagucgaggccuuuccucagucuaaugcagugauacaagaugaagagagggacauucccgaacgcagcuggaacaguggauacgauuggaucaccgacuucccaggcaaaacugugugguuugucccuuccauuaagagcggcaaugauaucgccaacugucugcggaaaaacgggaagagaguaauacagcucucuagaaagacauucgacaccgaguaucagaaaacaaagaauaacgacugggauuacgugguuacuacggacauuucagagaugggagcuaauuucagggcggaucgcgugaucgacccccguagaugccugaaaccagucauccuuaaggaugguccggaacgggugauucuagccggcccuaugcccguuaccguggcauccgcugcccagaggcgcgggcgaaucggaagaaaccaaaauaaagagggcgaccaguacgucuauaugggucagccacugaacaaugaugaagaccacgcacauuggacagaggccaagauguuguuagauaacauuaauacucccgaggggauaaucccugcucuguuugaaccagagcgggaaaagagugccgcgauugacggcgaguacaggcuccgcggagaagcaagaaaaaccuucguggagcugaugaggcggggcgaucuucccguauggcugagcuauaagguggccucggagggguuucaguacucugaccgucgcuggugcuucgauggagaacgaaacaaucaaguucucgaggaaaacauggacgucgagaucuggacaaaagaaggugagagaaagaaauugaggccucgguggcuggacgcucgcaccuauuccgauccgcuagcccugagagaguuuaaggaguucgcugcaggcaggcggagcgugucaggggaccucauccuugagauuggaaaacugccacagcacuuaacuuugcgagcccagaaugcucuggauaaccucgugaugcugcacaauagugaacagggcgguaaggccuacagacaugcaauggaggaacuucccgacacgauagagacccugaugcucuuggcgcugaucgccgucuuaacagggggcguuacucuauuuuuccugucuggaaagggccucgggaaaaccuccauuggacuucugugugugacagcuagcucagccuugcuguggauggcaaguguagagccucacuggaucgcugccagcauuauccucgaauuuuuccugauggugcuucucauacccgagccagaucgccaaaggaccccucaggacaaccagcuggcauaugucgugaucgguuugcuguuuaugauuuuaacuguugccgcuaacgaaaugggccuacuggagacaacgaagaaagaucucgggaucggacauguggcggccgagaaucaccaacacgcaaccaugcuugacgucgaucugcggcccgcuuccgccuggacuuuguacgccguagcaacaaccgugauuaccccaaugaugcgucauacaaucgaaaacacuacggcuaauauaucucugaccgccauugcgaaccaggcugccauccucaugggccuggacaaggguuggccuauuagcaaaauggauaucgggguuccgcuuuuagcacugggcugcuacucccaggugaauccccucacauugacugccgcuguccugaugcuaguggcacacuaugccauaaucggaccaggccugcaggcgaaggcuaccagagaggcccaaaagaggacagcagccgggauuaugaaaaacccuaccgucgacggaaucguggcuauugaucucgaccccguuguguacgacgccaaguucgaaaaacagcuuggccagaucaugcuguugauacuguguacuucacagauucuccugaugcgcacgacaugggcauuaugcgagucuaucacccuugcuacugguccacugaccacacucugggaagggaguccuggaaaguuuuggaauacuaccaucgccguaucgauggcgaacauuuuccggggcagcuaucuagccggugcaggccuggcuuucuccuugaugaaaucucuagggggaggccgaagagggacaggagcccaaggcgagacgcucggugagaaguggaagaggcagcuuaaucagcugucaaaaagcgaauuuaacaccuacaagcgcuccgggaucauggagguggaucggagugaagcaaaagagggauugaagagaggcgaaacuacaaaacaugcugucucucgugguaccgccaagcugaggugguucguugagcggaaucucgugaagcccgagggcaaagucauagacuuaggguguggacgcggcggguggagcuauuacugcgccggacugaagaaagugacugaaguaaagggcuauacaaaaggugggccgggacacgaggaaccaauuccuauggcgaccuacggcuggaaccuugugaagcugcauucaggcaaagauguauuuuucaugcccccagagaagugugacacgcuacucugcgauaucggggaauccagucccaauccuaccauugaggagggacgaacacugagaguguugaagauggucgaaccguggcugagggguaaccaguuuuguaucaaaauacucaaucccuacaugccaagcguggucgagacucuugaacaaaugcagcggaagcacggcgggaugcuggugcgcaacccuuuaucuagaaauuccacccacgagauguauuggguuucaugcggaacaggcaacaucguaagcgcugugaacaugacuucgaggaugcuguugaaucgauucaccauggcacaucggaaacccacauacgagcgugacgucgaucucggugccgggaccagacacguggcuguugaaccugagguggccaaccuggacauuaucggacagcgcauugaaaauaucaagaacgagcauaaaucuacuuggcacuaugaugaagacaauccauacaagacgugggcauaucacggcaguuacgaggucaagcccuccggcagcgccucauccauggugaacgggguagugaggcuacuuacaaaaccuugggauguuauuccaauggucacccaaaucgcuaugacugacaccacacccuuuggacagcagcggguguucaaggagaaaguggacacgagaaccccgcgcgcgaagagggguacuacacagauaauggaagucaccgccaaauggcuguggggcuuucucucucgaaauaagaagccucggauuuguacuagagaggaguucacaaggaaaguucgcagcaacgcagcuaucggggccguguuuguagaugagaaucaauggaacagugcaaaggaagccguggaggacgagcguuucugggaucugguccaucgggaaagagaguugcacaaacagggaaagugcgcuaccugcguguauaauaugaugggcaaaagggaaaagaagcugggugaguuugggaaagccaagggaucccgcgcgaucugguacauguggcucggcgcacgauuccuugaguucgaggcccugggcuuuaugaacgaggaccauugguucagccgggaaaauucuuuaucagggguugagggagaaggucugcacaaauugggcuacauucucagagauauaaguaagaucccagggggaaacauguaugcugacgauacagccggcugggacacuaggauuaccgaggaugaccugcagaaugaggcaaaaaucacggaaauuauggagcccgaacaugcucuacuugccaccuccaucuuuaagcugacauaccagaacaaagugguccgcgugcaaagaccugcuaagaacgguacuguaauggauguuauaagccggagggaccagcgugggucuggacaggugggcaccuauggccucaauacauucacuaacauggagguccagcugauccgacaaauggaaucggaggggauauuuuugccaucagaguuagaaacccccaaucuggccgagcgcgugcucgauuggcuugaaaagcacggagcagagagacugaaacggauggcgaucagcggugacgacuguguggucaagccgauugaugacagguucgccacggcucuaacagcccugaacgauaugggcaaaguucgcaaggacaucccucagugggaacccuccaaaggguggaaugauuggcaacaggugccauuuugcagucaccauuuccaccaacucauaaugaaggacggaagagagauuguagugccuugucggaaccaggaugaguuggucggcagggcacgagugucucagggugcuggguggagccugcgugaaaccgccugccuuggaaaguccuacgcacaaauguggcagcugauguauuuucauagacgcgaccuccgguuagccgcgaaugcuaucuguucagccguucccguggauugggucccaacaaguaggacaaccuggucuauccacgcacaccaucaguggaugacuaccgaggacaugcugagcguguggaacagaguauggauugaagagaaucccuggauggaagauaaaacacacguuuccucaugggaggaggugccuuacuugggcaagcgcgaagaccaguggugcggcagccugauagggcucacggcccgggcuaccugggccacuaacauccaagucgcaauuaaucaggugaggcgacuuaucggaaacgagaauuaucuggacuacaugacaucuaugaaaagauucaagaacgaauccgauccagagggugcucuaugguga

SEQ ID NO: 13355 - RNA, 9879 nt, Artificial Sequence
  derived and/or modified CDS sequence (opt3) from DENV-1__KF955443__SS-prME
agcgugaccaugcugcucaugcuucugccaacagcauuggcuuuccacuuaacuacgcgaggaggggagccucauaugaucgucuccaagcaggaaaggggaaaaucucugcuguuuaagaccucagccgguguuaacaugugcacccucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagaugaguggaacgaccacaauauuugccggccaucuaaaaugccggcucaagauggacaaacugacucuuaaggggaccucuuaugucauguguacaggauccuucaaauuggagaaggaaguggcugagacucagcacgguaccguccuggugcaaguuaaguacgagggcacggaugcgccuugcaaaaucccauucagcacacaggacgaaaagggggugacccagaacggacgucucauuacugcaaaucccaucguaacagauaaagagaagccugucaacauagaaaccgagccacccuuuggcgagucguauauugugguuggugccggggaaaaagcucugaaacuuucuugguucaagaaaggcuccucaaucggaaagauguuugaggccacugcacgcggcgccagaaggauggcuauccugggggacaccgccugggauuucggaaguauugguggcguguuuacaagcgucgggaaauuggugcaucagguauucggaacggcauacggcgugcucuuuuccgguguuucuuggaccaugaagaucgggauuggcauacuguuaacuuggcugggacuaaauagccggucaacaagucucuccaugaccuguaucgcggucggcauggugacacuguaccuuggggugaugguccaagcugacagcggaugcguuauuaacuggaaaggccgagaauugaagugugguucugggaucuucgugacuaacgaggugcacaccuggacggaacaguauaaguuucaggccgauucaccgaaacgccugagugcagccaucggaaaggcuugggaggagggcguaugcgguauuagaagcgucacaaggcucgaaaauauaauguggaaacagaucuccaacgagcugaaucauauuuuacuggaaaacgacaugaaguucaccgugguugugggcgacgccaaugggauccuugcacaaggcaagaagaugauucggccucagcccauggagcacaaauacucuuggaagucguggggcaaggcuaaaaucauaggggccgauauccagaacacuaccuuuauuaucgacggaccagauacaccugaaugucccgacaaucagcgcgcguggaacauuugggaggucgaggauuauggcuucgguaucuuuacuaccaauauaugguugaagcucagagacagcuacacacaaaugugcgaucacaggcugauguccgccgcuauuaaagacucaaaggcagugcaugccgauaugggguauuggaucgaaagugagaaaaacgaaacguggaagcuagcucgugccucuuucauugagguuaagaccuguacuuggccaaaaagccacacacugugguccaauggagugcucgaaucagagaugaucauacccaagaucuacggcgguccuauuagccagcauaacuaucggccaggcuacuucacccagacugcagggccguggcaccugggaaaacuugaguuggacuuugaucugugcgaaggcacaaccguagucguggacgagcacugcgggaaucgaggacccucuuuaagaacgacuaccgugacaggcaagaucauucaugaaugguguugcagguccuguacccucccuccacugcgcuuccggggugaggaugggugcugguacggaauggagaucagacccgucaaagaaaaggaggaaaaccuuguuaggaguauggugagcgcgggcucuggugagguagacuccuuuucacugggcauauugugugccaguauuaugaucgaagaggugaugcgcagccgauggucgcggaagaugcucaugacugggacacuggcugucuuccuacugcucaucaugggacaacugaccuggaaugaccuuauucguuugugcaucauggugggcgccaacgcauccgauagaauggggaugggaacaacuuaucuggcuuuaauggccaccuuuaaaaugaggccuauguucgcaguuggccuccuguuucgccggcuuacgucuagagaggugcugcuacucacaauuggucugagcuuggucgccucaguggaacugccaaacaguuuagaggaacucggggacggacuggcuaugggcauaaugaugcuuaagcuguugaccgaguuccagccccaccagcucuggacuacccugcuaucccugacauuuaucaaaacuacccuuucucucgauuacgcguggaagacgacagccauggcacugagcauuguuuccuuguucccgcuguguuuaucaaccacuagccagaaaacaaccuggcucccugugcugcuuggcaguuuugggugcaagccacugacuauguucuugaucacagaaaauaagauuuggggaaggaaaucuuggccccucaacgaggguaucauggcuauaggcaucgucuccauucugcuaagcucgcugcuuaagaaugacguaccucucgccgggccccugaucgccggaggcauguugauugcuuguuaugugaucucagguucuagugcagauuuaucccuggagaaagccgcggaaguuagcugggagcaagaagcugagcauucugggaccagccacaacauacucguggaaguccaggacgauggaacgaugaagauuaaagacgaggagcgagaugacacucugaccauccuucugaaggccacauugcuagcaguguccggcguauacccaaugucaaucccugccacccuguuucucugguauuucuggcagaaaaagaagcagcgcaguggcgugcugugggauacacccagcccaccggaagucgagcgggcuguucuugacgaugggauuuacagaauauuacaaaggggacugcucggucguucucaggugggcgugggggucuuccaggacggaguguuucauacuauguggcacguuacccgcggcgcaguauugauguaucaggguaaacggcuggaaccuuccugggccucagugaagaaagaccucaucaguuacgggggaggcuggagauuccaaggcagcuggaauacgggggaggagguccaggugauugcgguugaacccggaaagaaccccaaaaaugugcagacaacucccgguaccuuuaagacaccugagggcgaagucggggcuaucgcccuggauuucaagccaggaaccuccggcucucccauugugaacagggaggguaaaaucguagggcuuuacggaaauggcgucgugacuaccucgggcacauauguuagcgcaauagcccaagcuaaggccucacaggaagggccucugccggagaucgaggacgaaguguuuaaaaagcgaaacuugacgauuauggaucuacacccaggauccgguaaaacucggcgcuaccugcccgcaaucgucagagaggcuauuaagaggaagcuccggaccuuaauccuggccccuacacgagugguugcgagugaaauggccgaggcacuuaaaggcaugccaauaagauaucagaccacugcugugaagucugaacauacagggcgcgagauugucgaccugaugugccacgccaccuucacgaugaggcucuugagccccgugcguguaccuaauuacaacaugaucaucauggaugaggcucauuuuacugacccggcauccauugccgcccggggauauaucucaacaagagugggcaugggugaagcugcggcaauauucaugaccgccacacccccagggucuguugaggcuuuuccucagagcaaugccgucauucaagaugaagagagggacauccccgaacgcaguuggaacuccggauacgauuggauuacugacuucccaggcaaaacagugugguuugugccuagcaucaagucuggcaaugauauagcaaacugucugcggaaaaaugggaagagagucauucagcucucaagaaagaccuucgacacagaguaucagaaaacuaagaauaacgacugggauuacguagugacgaccgacaucuccgagaugggagccaauuucagggcugaucgcguuaucgacccccguagaugccugaaaccagugauucuuaaggaugguccggaacgggucauccuagcgggcccuaugcccgugacaguugccagugcagcucagaggcgcgggcgaauuggaagaaaccaaaauaaagagggcgaccaguacguguauaugggucagccacugaacaaugaugaagaccacgcccauuggacugaggcaaagauguuguuagauaacauaaauacccccgaggggaucauuccugcccuguuugaaccagagcgggaaaagagcgcugccaucgacggcgaguacaggcuccgcggagaagcgagaaaaacauucgucgagcugaugaggcggggcgaucuucccguguggcugucguauaagguagcaucugagggguuucaguacuccgaccgucgcuggugcuucgauggagaacgaaacaaucaagugcucgaggaaaacauggacguugagaucuggaccaaagaaggugagagaaagaaauugaggccucgguggcuggacgcccgcacuuauagcgauccgcuagcucugagagaguuuaaggaguucgccgcuggcaggcggucagucaguggggaccucauucuugagauaggaaaacugccacagcacuuaacguugcgagcacagaaugcccuggauaaccucgugaugcugcacaauucugaacagggcgguaaggcuuacagacaugccauggaggaacuucccgacaccaucgagacacugaugcucuuggcacugauugcgguguuaacugggggcgucacccuauuuuuccuguccggaaagggccucgggaaaacaagcaucggacuucuguguguuaccgccucaagugcuuugcuguggauggccagcguggagccucacuggauugcagcuuccaucauacucgaauuuuuccugaugguacuucucauccccgagccagaucgccaaaggacuccucaggacaaccagcuggccuauguggucauugguuugcuguuuaugaucuuaacaguggcagccaacgaaaugggccuacuggagacgaccaagaaagaucucgggauuggacauguugcugcggagaaucaccaacacgccacuaugcuugacguggaucugcggcccgcaucugcuuggacauuguacgccgucgccaccaccguaaucacaccaaugaugcgucauacuauagaaaacacgaccgcaaauauuagccugacagcuaucgccaaccaggcggcuauucucaugggccuggacaaggguuggccuaucuccaaaauggauauaggggugccgcuuuuagcccugggcugcuacucacagguuaauccccucacuuugaccgcagccgugcugaugcuagucgcucacuaugcaaucauuggaccaggccugcaggccaaggcgacaagagaggcucaaaagaggaccgccgcagggaucaugaaaaacccuacuguggacggaauugucgccaucgaucucgaccccgugguuuacgacgcuaaguucgaaaaacagcuuggccagauaaugcuguugauucuguguacgucucagauccuccugaugcgcacaaccugggccuuaugcgagaguaucacucuugcaaccgguccacugacaacucucugggaagggucgccuggaaaguuuuggaauaccacaauugcugugagcauggccaacaucuuccggggcuccuaucuagcgggugccggccuggcauucucuuugaugaaaucacuagggggaggccgaagagggacgggagcucaaggcgagacccucggugagaaguggaagaggcagcuuaaucagcugagcaaauccgaauuuaacacuuacaagcgcagugggauaauggagguagaucggucugaagccaaagagggauugaagagaggcgaaacaaccaaacaugcagugagccgugguacugcuaagcugaggugguucgucgagcggaaucucguuaagcccgagggcaaagugauugacuuaggguguggacgcggcggguggucauauuacugcgccggacugaagaaagucacagaagugaagggcuauaccaaaggugggccgggacacgaggaaccaaucccuauggccacguacggcuggacccuuguaaagcugcauuccggcaaagauguguuuuucaugcccccagagaagugugacacacuacucugcgauauuggggaaaguagccccaacccuacuaucgaggagggacgaacccugagaguuuugaagaugguggaaccguggcugagggguaaucaguuuuguauaaaaauccucaaccccuacaugccaucugucguggagacacuugaacaaaugcagcggaagcacggcgggaugcugguccgcaauccuuuauccagaaacucaacucacgagauguauugggugagcugcggaaccggcaauauuguuucggcgguaaacaugacaucuaggaugcuguugaaccgauucaccauggcucaucggaaacccacuuuugagcgugacguggaucucggugcagggacgagacacgucgccguggaaccugagguugcuaaucuggacaucauuggacagcgcaucgaaaacauuaagaaugagcauaaaaguacauggcacuacgaugaagacaacccauauaagaccugggccuaccacggcuccuaugaggugaagcccagcggcucagcauccucuauggucaauggggugguaaggcuacuuacuaaaccuugggaugugaucccaaugguuacccaaauagccaugacagacacgacccccuucggacagcagcgggucuuuaaggagaaaguggacacuagaacaccgcgcgcuaagagggguaccacucagauuauggaagugacagcgaaauggcuguggggcuuccucagccgaaacaagaagccucggaucuguaccagagaggaauuuacaaggaaaguccgcaguaaugccgcaaucggggcuguuuucguggaugagaaccaauggaacuccgccaaggaagcaguagaggacgagcguuuuugggaucuggugcaucgggaaagagaguugcacaaacagggaaagugcgccacuugcgucuacaacaugaugggcaaaagggaaaagaagcugggugaguucgggaaagcuaagggaagccgcgccauuugguauauguggcucggcgcgcgauuccuugaauuugaggcacugggcuucaugaaugaggaccauugguuuucucgggaaaacucauuaagugggguggagggagaaggucugcacaaauugggcuacauacucagagauaucuccaagauuccagggggaaauauguacgccgacgauaccgcuggcugggacacgaggaucaccgaggaugaccugcagaacgaggccaaaauuacagauaucauggaacccgagcaugcacuacuugcuacuagcauauucaagcugaccuaucagaauaaaguugugcgcguccaaagaccugccaagaacgguacagugauggacguaaucucucggagggaucagcgugggucgggacagguuggcacuuacggccucaacaccuuuacgaauauggaagugcagcugauucgacaaauggagucagaagggaucuucuugccaagcgaguuagagacacccaaccuggcugaacgcguccucgacuggcuugagaagcacggagccgaaagacugaaacggauggcaauuuccggugacgauuguguggugaagccgaucgacgauagguuugcgaccgcccuaacugcucugaaugacaugggcaaaguccgcaaggauauaccucagugggagcccaguaaaggguggaacgacuggcagcagguuccauucugcucucaccauuuucaccaacucauuaugaaggauggaagagaaaucgugguaccuugucggaaucaggacgaguuggugggcagggcccgagucagccagggugcaggguggucccugcgugagacagcuugccuuggaaagucauaugcccaaauguggcagcugauguacuuccauagacgcgaucuccgguuagcagccaacgcgaucuguagugcugugcccguugacugggugccaaccucuaggacuaccuggagcauucacgcccaccaucaguggaugacaacggaagauaugcuguccgucuggaauagaguguggauagaggaaaaccccuggauggaggacaaaacccacguaucaagcugggaagagguuccuuauuugggcaagcgcgaggaccaguggugcggcucucugaucgggcucacugcacgggccacaugggcuaccaauauucaaguggccaucaaccaggucaggcgacuuauuggaaaugaaaacuaccuggauuauaugacuuccaugaaaagauuuaagaaugagagugacccagaaggugcacuaugguga

SEQ ID NO: 13356 - RNA, 9879 nt, Artificial Sequence
  derived and/or modified CDS sequence (opt3) from DENV-1__GQ868520__SS-prME
agcgugaccaugcugcucaugcuucugccaacagcauuggcuuuccacuuaacuacgagaggaggggaaccucauaugaucgucuccaagcaggaaaggggaaaaucucuguuguuuaagaccucagccgguguuaacaugugcacccucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggaccacacugcuaucccugacuuuuauaaaaaccacgcuuucucucgauuacgccuggaagacaaccgcaauggcucugagcaucguuuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauuauggccaucggcauagucuccauccugcuaagcucgcugcuuaagaaugacguaccucucgccgggccccugauugcuggaggcauguugaucgcauguuaugugauuucagguucuagugccgauuuaucccuggagaaagcggcugaaguuagcugggagcaagaagccgagcauucugggacgagccacaacauccucguggaaguccaggacgauggaacuaugaagauaaaagacgaggagcgagaugacacccugacaauucuucugaaggcaaccuugcuagccguguccggcguauacccaaugucaaucccugcuacacuguuugugugguauuucuggcagaaaaagaagcagcgcaguggcguccucugggauacucccagcccaccggaaguugagcgggcagugcuggacgaugggaucuacaggauucuucaacgaggauuacugggucguucucaggugggcgucgggguguuccaggacggaguuuuucauaccauguggcacguaacgcgcggcgccgugcucauguaucaggguaaacgguuggaaccuuccugggcgucagucaagaaagaccugauaaguuacgggggaggcuggagauuccaaggcagcuggaauacaggggaggaggugcagguuaucgcuguggaacccggaaagaaccccaagaauguccagacuaugcccgguaccuuuaagacaccugagggcgaagugggggccauugcacucgauuucaagccaggaaccuccggcucucccaucguaaacagggaggguaaaauugucgggcuguacggaaauggcgugguuacuaccucgggcacauaugugagcgccaucgcucaagccaaggcaucacaggaagggccucuuccggagauagaggacgaagucuuuaaaaagcgaaaccugacgaucauggauuugcacccaggauccgguaaaacucggcgcuaccuacccgcuauggugagagaggccauuaagaggaagcugcggacccucaucuuagcgccuacacgaguuguggccagugaaauggcagaggcucugaaaggcaugccaauuagauaucagaccacugccgucaagucugaacauacagggcgcgagaucguggaccuuaugugccacgcuaccuucacgaugaggcugcucagccccguacgugugccuaauuacaacaugauaauuauggaugaggcacauuuuacugacccggccuccaucgccgcucggggauauaucucaacaagaguuggcaugggugaagcggcagccauuuucaugaccgcuacacccccagggucugucgaggccuuuccucagagcaaugcagugauccaagaugaagagagggacauacccgaacgcaguuggaacuccggauacgauuggauuacugacuucccaggcaaaacagugugguuugucccuagcaucaagucuggcaaugauauugccaacuguuugagaaagaacgggaagagaguaauccagcugucacggaagaccuucgacacagaguaucagaaaacuaagaauaacgacugggauuacgugguuacgaccgacauauccgagaugggagcuaauuucagggcggaucgcgugauugacccccguagaugccucaaaccagucauccugaaggaugguccggaacgggugauccuugccggcccuaugcccguuacaguggcaagugcugcccagaggcgcgggcgaauuggaagaaaccaaaauaaagagggcgaccaguacgucuauaugggucagccacuaaacaaugaugaagaccacgcacauuggacugaggccaagaugcuguuggauaacaucaauacccccgaggggauuauaccugcuuuauuugaaccagagcgggaaaagagcgccgcgaucgacggcgaguacaggcugcgcggagaagcaagaaaaacauucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagauuuggaccaaagaaggugagagaaagaaacucaggccucggugguuggacgcucgcacuuauagcgauccgcuggcccuaagagaguuuaaggaguucgcugcaggcaggcggucagugaguggggaccugauccucgagaucggaaaacuuccacagcaccugacguuacgagcccagaaugcuuuggauaaccuggugaugcuccacaauucugaacagggcgguaaggccuacagacaugcaauggaggaacugcccgacaccauugagacacuuaugcugcucgcguugauagccguccugacugggggcguuaccuuauuuuuccuauccggaaagggccuggggaaaacaagcaucggacuccuuugugugaccgcuucaagugcccuguuguggauggcaagcguagagccucacuggauugcugccuccaucauucuggaauuuuuccucauggugcugcuuauccccgagccagaucgccaaaggacuccucaggacaaccagcucgcauaugucgugauaggucuguuguuuaugauccugacaguugccgcuaacgaaaugggcuuacuagagacgaccaagaaagaucuggggauuggacauguggcggccgagaaucaccaacacgcaacuaugcucgacgucgaucuucggcccgcuucugccuggacacuguacgccguagcaaccaccgugaucacaccaaugaugcgucauacuauugaaaacacgaccgcuaauaucagcuugacagccauagcgaaccaggcugccauucugaugggccucgacaaggguuggccuaucuccaaaauggauauugggguuccgcugcuugcauuaggcugcuacucacaggugaauccccugacucucaccgccgcugucuugaugcugguggcacacuaugccaucauaggaccaggccuacaggcgaaggcuacaagagaggcccaaaagaggaccgcagccgggaucaugaaaaacccuacugucgacggaauuguggcuaucgaucuggaccccguuguguacgacgccaaguucgaaaaacagcucggccagauuaugcuucugaucuuguguacgucucagauacugcucaugcgcacaaccugggcacugugcgagaguauuacuuuagcuaccgguccacuuacaacucugugggaagggucgccuggaaaguuuuggaauaccacaaucgccguaagcauggcgaacaucuuccggggcuccuaucucgccggugcaggccuagcuuucucucugaugaaaucacuagggggaggccgaagagggacgggagcccaaggcgagacccugggugagaaguggaagaggcagcucaaucagcuuagcaaauccgaauuuaacacuuacaagcgcagugggauuauggagguggaucggucugaagcaaaagagggacugaagagaggcgaaacaaccaaacaugcugucagccgugguacugccaaguugaggugguucguugagcggaaucuggugaagcccgagggcaaagucaucgaccucggguguggacgcggcggguggucauauuacugcgccggauuaaagaaagugacagaaguaaagggcuauaccaaaggugggccgggacacgaggaaccaauaccuauggcgacguacggcuggaaccuggugaaacuucauuccggcaaagauguauuuuucaugcccccagagaagugugacacccugcuaugcgauauuggggaaaguagccccaauccuacaaucgaggagggacgaacucucagagugcugaagauggucgaaccgugguugagggguaaccaguuuuguauuaaaauccugaaucccuacaugccaucuguggucgagacccucgaacaaaugcagcggaagcacggcgggaugcuugugcgcaacccucuguccagaaauucaacacacgagauguauuggguuagcugcggaacuggcaacauaguaucggcugugaacaugaccucuaggauguuacugaaucgauucacaauggcacaucggaaacccaccuacgagcgugacgucgauuugggugccgggacuagacacguggcuguugaaccugagguggccaaccucgacaucauuggacagcgcaucgaaaauauuaagaacgagcauaaaaguacguggcacuaugaugaagacaauccauacaagacaugggcauaucacggcuccuacgaggucaagcccagcggcucagccuccucuauggugaacgggguagugaggcugcuaaccaaaccuugggauguuaucccaauggucacucaaauugcuaugaccgacacaacgcccuuuggacagcagcggguguucaaggagaaaguggacaccagaacuccgcgcgcgaagagggguacaacccagaucauggaagucacugccaaauggcuuuggggcuuucugagccgaaauaagaagccucggauauguacaagagaggaguucaccaggaaaguucgcaguaacgcagcuauuggggccguguuuguagaugagaaucaauggaacuccgcaaaggaagccguggaggacgagcguuucugggaucucguccaucgggaaagagagcugcacaaacagggaaagugcgcuacaugcguguauaauaugaugggcaaaagggaaaagaaguugggugaguuugggaaagccaagggaagccgcgcgaucugguacauguggcugggcgcacgauuccucgaguucgaggcccuuggcuuuaugaacgaggaccauugguucucucgggaaaauucacugagugggguugagggagaagguuuacacaaacugggcuacaucuugagagauauuuccaagauaccagggggaaacauguaugcugacgauacugccggcugggacaccaggaucacggaggaugaccuccagaaugaggcaaaaauuaccgaaaucauggagcccgaacaugcucugcuagccacaagcauuuuuaaacuuacuuaccagaacaaagugguccgcgugcaaagaccugcuaagaacgguaccguaauggauguuaucucucggagggaccagcgugggucgggacaggugggcacauauggccugaauacuuucaccaacauggagguccagcucauacgacaaauggaaucagaggggaucuuucugccaagcgaguuggaaacgcccaauuuagccgagcgcgugcuggauuggcucgaaaagcacggagcagagagacuuaaacggauggcgauuuccggugacgacuguguggucaagccgaucgaugacagguucgccacagcucugaccgcccuaaacgauaugggcaaaguucgcaaggacauuccucagugggaacccaguaaaggguggaaugauuggcaacaggugccauuuugcucucaccauuuccaccaacugaucaugaaggacggaagagagauaguagugccuugucggaaccaggaugagcucgucggcagggcacgagugagccagggugcugggugguccuugcgugaaacugccugccugggaaagucauacgcacaaauguggcagcuuauguauuuucauagacgcgaccugcggcucgccgcgaaugcuauuuguagugccguucccguggauugggucccaacaucuaggaccacuuggagcauccacgcacaccaucaguggaugaccacagaggacauguuauccguguggaacagaguauggaucgaagagaaucccuggauggaagauaaaacgcacguuucaagcugggaggaggugccuuaccugggcaagcgcgaagaccaguggugcggcucuuugauugggcugaccgcccgggcuacuugggccacaaacauacaagucgcaaucaaucaggugaggcgacucauuggaaacgagaauuaucuugacuacaugaccuccaugaaaagauucaagaacgaaagugauccagagggugcucugugguga

SEQ ID NO: 13357 - RNA, 9879 nt, Artificial Sequence
  derived and/or modified CDS sequence (opt3) from DENV-1__GQ868522__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggauaacccugcuaucccugacauuuaucaaaacuacccuuucucucgauuacgccuggaagacgacagcaauggcucugagcauuguuuccuuguucccgcuguguuuaucaaccacuagccagaaaacaaccuggcucccugugcugcuuggcaguuuugggugcaagccacugacuauguucuugaucacagaaaauaagauuuggggaaggaaaucuuggccccucaacgaggguaucauggccauaggcaucgucuccauucugcuaagcucgcugcuuaagaaugacguaccucucgccgggccccugaucgcuggaggcauguugauugcauguuaugugaucucagguucuagugccgauuuaucccuggagaaagcggcugaaguuagcugggagcaagaagccgagcauucugggaccagccacaacauacucguggaaguccaggacgauggaacgaugaagauuaaagacgaggagcgagaugacacucugaccauccuucugaaggcaacauugcuagccguguccggcguauacccaaugucaaucccugcuacccuguuugugugguauuucuggcagaaaaagaagcagcgcaguggcguccucugggauacacccagcccaccggaaguugagcgggcagugcuggacgaugggauuuacagaauacuucaaaggggauuacugggucguucucaggugggcgucgggguguuccaggacggaguuuuucauacuauguggcacguaacccgcggcgccgugcucauguaucaggguaaacgguuggaaccuuccugggcgucagucaagaaagaccugaucaguuacgggggaggcuggagauuccaaggcagcuggaauacgggggaggaggugcagguuauugcuguggaacccggaaagaacccaaaaaauguccagacaaugcccgguacuuuuaagaccccugagggcgaagugggggccaucgcacucgauuucaagccaggaacauccggcucucccauuguaaacagggaggguaaaaucgucgggcuguacggaaauggcgugguuaccacuucgggcaccuaugugagcgccauagcucaagccaaggcaucacaggaagggccucuuccggagaucgaggacgaagucuuuaaaaagcgaaaccugacaauuauggauuugcacccaggauccgguaaaacgcggcgcuaccuacccgcuauggugagagaggccaucaagaggaagcugcggacucucauuuuagcgccuacccgaguuguggccagugaaauggcagaggcucugaaaggcaugccaaucagauaucagacaaccgccgucaagucugaacauacugggcgcgagauaguggaccuuaugugccacgcuacauucaccaugaggcugcucagccccguacgugugccuaauuacaacaugauuaucauggaugaggcacauuuuacggacccggccuccaucgccgcucggggauauauuucaacuagaguuggcaugggugaagcggcagccaucuucaugacagcuacccccccagggucugucgaggccuuuccucagagcaaugcagugauacaagaugaagagagggacauucccgaacgcaguuggaacuccggauacgauuggaucaccgacuucccaggcaaaacugugugguuugucccuagcauuaagucuggcaaugauaucgccaacuguuugcgaaaaaacgggaagagaguaauacagcugucacggaagacauucgacaccgaguaucagaaaacaaagaauaacgacugggauuacgugguuacuacggacauuuccgagaugggagcuaauuucagggcggaucgcgugaucgacccccguagaugccucaaaccagucauccugaaggaugguccggaacgggugauucuugccggcccuaugcccguuaccguggcaagugcugcccagaggcgcgggcgaaucggaagaaaccaaaauaaagagggcgaccaguacgucuauaugggucagccacuaaacaaugaugaagaccacgcacauuggacagaggccaagaugcuguuggauaacauuaauacucccgaggggauaaucccugcuuuauuugaaccagagcgggaaaagagcgccgcgauugacggcgaguacaggcugcgcggagaagcaagaaaaaccuucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagaucuggacaaaagaaggugagagaaagaaacucaggccucggugguuggacgcucgcaccuauagcgauccgcuggcccuaagagaguuuaaggaauucgcugcaggcaggcggucagugaguggggaccugauccucgagauuggaaaacuuccacagcaccugacuuuacgagcccagaaugcuuuggauaaccuggugaugcuccacaauucugaacagggcgguaaggccuacagacaugcaauggaggaacugcccgacacgauagagacccuuaugcugcucgcguugaucgccguccugacagggggcguuacuuuauuuuuccuauccggaaagggccuggggaaaaccagcauuggacuccuuugugugacagcuucaagugcccuguuguggauggcaagcguagagccucacuggaucgcugccuccauuauccuggaauuuuuccucauggugcugcuuauacccgagccagaucgccaaaggaccccucaggacaaccagcucgcauaugucgugaucggucuguuguuuaugauucugacuguugccgcuaacgaaaugggcuuacuagagacaacgaagaaagaucuggggaucggacauguggcggccgagaaucaccaacacgcaaccaugcucgacgucgaucuucggcccgcuucugccuggacucuguacgccguagcaacaaccgugauuaccccaaugaugcgucauacaaucgaaaacacuacggcuaauauaagcuugaccgccauugcgaaccaggcugccauccugaugggccucgacaaggguuggccuauuuccaaaauggauaucgggguuccgcugcuugcauuaggcugcuacucacaggugaauccccugacacucacugccgcugucuugaugcugguggcacacuaugccauaaucggaccaggccuacaggcgaaggcuaccagagaggcccaaaagaggacagcagccgggauuaugaaaaacccuaccgucgacggaaucguggcuauugaucuggaccccguuguguacgacgccaaguucgaaaaacagcucggccagaucaugcuucugauauuguguacuucucagauucugcucaugcgcacgacaugggcacugugcgagaguaucaccuuagcuacugguccacuuaccacacugugggaagggucgccuggaaaguuuuggaauacuaccaucgccguaagcauggcgaacauuuuccggggcuccuaucucgccggugcaggccuagcuuucucucugaugaaaucauuggggggaggccgaagagggacaggagcccaaggcgagacgcugggugagaaguggaagaggcagcucaaucagcuuagcaaauccgaauuuaacaccuacaagcgcagugggaucauggagguggaucggucugaagcaaaagagggacugaagagaggcgaaacuacaaaacaugcugucagccgugguaccgccaaguugaggugguucguugagcggaaucuggugaagcccgagggcaaagucauagaccucggguguggacgcggcggguggucauauuacugcgccggauuaaagaaagugacugaaguaaagggcuauacaaaaggugggccgggacacgaggaaccaauuccuauggcgaccuacggcuggaaccuggugaagcuucauuccggcaaagauguuuuuuucaugcccccagagaagugugacacgcugcuaugcgauaucggggaaaguagccccaauccuaccauugaggagggacgaacacucagagugcugaagauggucgaaccgugguugagggguaaccaguuuuguaucaaaauacugaaucccuacaugccaucuguggucgagacucucgaacaaaugcagcggaagcacggcgggaugcuugugcgcaacccucuguccagaaauucaacccacgagauguauuggguuagcugcggaacaggcaacaucguaucggcugugaacaugacuucuaggauguuacugaaucgauucaccauggcacaucggaaacccacauacgagcgugacgucgauuugggugccgggaccagacacguggcuguugaaccugagguggccaaccucgacauuaucggacagcgcauugaaaauaucaagaacgagcauaaaaguacuuggcacuaugaugaagacaauccauacaagacgugggcauaucacggcuccuacgaggucaagcccagcggcucagccuccucuauggugaacgggguagugaggcugcuaacaaaaccuugggauguuauuccaauggucacccaaaucgcuaugacugacaccacacccuuuggacagcagcggguguucaaggagaaaguggacacgagaaccccgcgcgcgaagagggguacuacacagauaauggaagucaccgccaaauggcuuuggggcuuucugagccgaaauaagaagccucggauuuguacuagagaggaauucacaaggaaaguucgcaguaacgcagcuaucggggccguguuuguagaugagaaucaauggaacuccgcaaaggaagccguggaggacgagcguuucugggaucucguccaucgggaaagagagcugcacaaacagggaaagugcgcuaccugcguguauaauaugaugggcaaaagggaaaagaaguugggugaguuugggaaagccaagggaagccgcgcgaucugguacauguggcugggcgcacgauuccucgaauucgaggcccuuggcuuuaugaacgaggaccauugguucucucgggaaaauucacugagugggguugagggagaagguuuacacaaacugggcuacauuuugagagauauauccaagaucccagggggaaacauguaugcugacgauacagccggcugggacacuaggauuaccgaggaugaccuccagaaugaggcaaaaaucacggaaauuauggagcccgaacaugcucugcuagccaccagcaucuuuaagcuuacauaccagaacaaagugguccgcgugcaaagaccugcuaagaacgguacuguaauggauguuauaucucggagggaccagcgugggucgggacaggugggcaccuauggccugaauacauucacuaacauggagguccagcucauccgacaaauggaaucagaggggauuuuucugccaagcgaguuggaaacccccaauuuagccgagcgcgugcuggauuggcucgaaaagcacggagcagagagacuuaaacggauggcgaucuccggugacgacuguguggucaagccgauugaugacagguucgccacggcucugacagcccuaaacgauaugggcaaaguucgcaaggacaucccucagugggaacccaguaaaggguggaaugauuggcagcaggcaccauuuugcucucaccauuuccaccaacugauaaugaaggacggaagagagauugugguaccuugucggaaccaggaugagcucgugggcagggcucgagucagccagggugccgggugguccuugcgugaaaccgcaugccugggaaagucauacgcccaaauguggcagcuuauguauuuucauagacgcgaccugcggcucgcggcuaaugccaucuguagugcagugcccguugauugggugccaacuucuaggacaaccuggagcauccacgcccaccaucaguggaugacuaccgaggacauguuauccgucuggaacagaguguggauugaagagaaucccuggauggaagauaaaacacacguaucaagcugggaggagguuccuuaccugggcaagcgcgaagaccaguggugcggcucuuugauagggcugacggcucgggccaccugggcaacuaacauccaaguggcuauuaaucaggucaggcgacucaucggaaacgagaauuaucuugacuacaugacauccaugaaaagauucaagaacgaaagugauccagagggugcccugugguga

SEQ ID NO: 13358 - RNA, 9879 nt, Artificial Sequence
  derived and/or modified CDS sequence (opt3) from DENV-1__HQ166036__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggaccacacugcuaucccugacuuuuauaaaaaccacgcuuucucucgauuacgccuggaagacaaccgcaauggcucugagcaucguuuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauuauggccaucggcauagucuccauccugcuaagcucgcugcuuaagaaugacguaccucucgccgggccccugauugcuggaggcauguugaucgcauguuaugugauuucagguucuagugccgauuuaucccuggagaaagcggcugaaguuagcugggagcaagaagccgagcauucugggacgagccacaacauccucguggaaguccaggacgauggaacuaugaagauaaaagacgaggagcgagaugacacccugacaauucuucugaaggcaaccuugcuagccguguccggcguauacccaaugucaaucccugcuacacuguuugugugguauuucuggcagaaaaagaagcagcgcaguggcguccucugggauacucccagcccaccggaaguugagcgggcagugcuggacgaugggaucuacagaauucuucaaaggggauuacugggucguucucaggugggcgucgggguguuccaggacggaguuuuucauaccauguggcacguaacgcgcggcgccgugcucauguaucaggguaaacgguuggaaccuuccugggcgucagucaagaaagaccugauaaguuacgggggaggcuggagauucaggggcagcuggaauacaggggaggaggugcaaguuaucgcuguggaacccggaaagaacccaaaaaauguccagacuacccccgguacauuuaagaccccugagggcgaagugggggccauugcacucgauuucaagccaggaacuuccggcucucccaucguaaaccgagaggguaaaauugucgggcuguacggaaauggcgugguuaccacaucgggcacguaugugagcgccaucgcucaggccaaggcaucacaagaagggccucuuccggagauagaggacgaagucuuuaaaaagcggaaccugacuaucauggauuugcacccaggauccgguaaaacccgcagauaccuacccgcuauugugagggaggccaucaagcggaagcugcgaacacucauuuuagcgccuaccagaguuguggccagugaaauggcagaggcucugaaaggcaugccaauccgcuaucagacuacagccgucaagucugaacauaccgggagggagauaguggaccuuaugugccacgcuacguucacuaugcgucugcucagccccguacgggugccuaauuacaacaugauuaucauggaugaggcacauuuuacagacccggccuccaucgccgcuagaggauauauuucaaccaggguuggcaugggugaagcggcagccaucuucaugaccgcuacucccccagggucugucgaggccuuuccucagagcaaugcagugauacaggaugaagagcgcgacauucccgaacgaaguuggaacuccggauacgauuggaucacagacuucccaggcaaaaccgugugguuugucccuagcauuaagucuggcaaugauaucgccaacuguuugagaaaaaacgggaagcggguaauacaacugucaaggaagacauucgacacugaguaucagaaaacgaagaauaacgacugggauuacgugguuaccacagacauuuccgagaugggagcuaauuuccgcgcggaucgugugaucgaccccagacggugccucaaaccagucauccugaaggaugguccggaaagggugauucuugccggcccuaugcccguuacuguggcaagugcugcccagcgccgagggagaaucggacggaaccagaauaaagagggcgaccaauacgucuauaugggucagccacuaaacaaugaugaagaccacgcacauuggaccgaggccaagaugcuguuggauaacauuaauacacccgaggggauaaucccugcuuuauuugaaccagagagggaaaagagcgccgcgauugacggcgaguaccgccugagaggagaagcaaggaaaaccuucguggagcucaugcggcguggcgaucugcccguauggcuuucguauaagguggccucugagggguuucaguacuccgaccgccgauggugcuucgauggagaaagaaacaaucagguucuggaggaaaacauggacgucgagaucuggacuaaagaaggugagaggaagaaacuccggccucgcugguuggacgcuagaacguauagcgauccgcuggcccuaagggaguuuaaggaauucgcugcaggccggcgaucagugaguggggaccugauccucgagauuggaaaacuuccacaacaccugaccucuagagcccagaaugcuuuagauaacuuggugaugcugcacaauuccgaacagggcgguaaggccuaccgccaugcaauggaggaacuccccgacacaauagagacucugaugcuucuggcgcucaucgccgucuugaccgggggcguuacacuguuuuucuuaagcggaaagggccuagggaaaaccucaauuggacugcucugugugacugcuaguagcgcccuucuguggauggcauccguagagccucacuggaucgcugccucuauuaucuuggaauuuuuccugauggugcuccugauacccgagccagauaggcagcggacaccucaagacaaccagcuugcauaugucgugaucggucuccuguuuaugauuuugacgguugccgcuaacgaaaugggccuguuagagaccacuaagaaagaucuagggaucggacauguggcggccgagaaucaccagcacgcaacaaugcuggacgucgaucuccgucccgcuagcgccuggacccuuuacgccguagcaaccacagugauuacuccaaugaugagacauacgaucgaaaacaccacagcuaauauaucccugacugccauugcgaaccaagcugccaucuugaugggccuggacaaggguuggccuauuucaaaaauggauaucgggguuccgcuccuggcacuuggcugcuacucucaggugaaucccuuaacccugacagccgcuguccucauguugguggcacacuaugccauaaucggaccaggccugcaggcgaaggcuaccagggaggcccagaagcgcacugcagccgggauuaugaaaaacccuacggucgacggaaucguggcuauugaucuagaccccguuguguacgacgccaaguucgaaaaacaacugggccagaucaugcuccuuauacuguguacaagucagauuuugcugaugcggaccacuugggcacucugcgagucgaucacccuggcuacagguccauuaacuacccuuugggaagggagcccuggaaaguuuuggaauacaacgaucgccguauccauggcgaacauuuuccgaggcucuuaucuggccggugcaggccucgcuuucucacuaaugaaaagccuggggggaggcagaagggggaccggagcccagggcgagacuuugggugagaaguggaagcgccaacugaaucagcucuccaaaagugaauuuaacacauacaagcggucugggaucauggagguggauagaagcgaagcaaaagagggacuuaagcguggcgaaaccacuaaacaugcugucucaagggguacagccaagcugcggugguucguugagcgcaauuuggugaagcccgagggcaaagucauagaccugggguguggacgaggcgggugguccuauuacugcgccggacucaagaaagugaccgaaguaaagggcuauacgaaaggugggccgggacacgaggaaccaauuccuauggcgaccuacggcuggaacuuagugaagcugcauaguggcaaagauguuuuuuucaugcccccagagaagugugacacacuucugugcgauaucggggaaagcucucccaauccuacuauugaggagggaagaacccuaagggugcucaagauggucgaaccguggcugcgggguaaccaguuuuguaucaaaauauugaaucccuacaugccauccguggucgagacacuggaacagaugcaacgcaagcacggcgggaugcucgugagaaacccucuuucaaggaauagcacucacgagauguauuggguuucgugcggaaccggcaacaucguaucugcugugaacaugacaagucgaaugcuguuaaaucgguucaccauggcacaucguaaacccacuuacgagagagacgucgaucugggugccgggacgcgccacguggcuguugaaccugagguggccaacuuggacauuaucggacagaggauugaaaauaucaagaacgagcauaaauccacauggcacuaugaugaagacaauccauacaagaccugggcauaucacggcagcuacgaggucaagcccucaggcuccgccucuagcauggugaacgggguagugcggcuccugacuaaaccuugggauguuauuccaauggucacccagaucgcuaugacagacacgacccccuuuggacaacagagaguguucaaggagaaaguggacacucgcacaccgagggcgaagcgagguaccacucagauaauggaagucacagccaaauggcuauggggcuuucuuagucggaauaagaagccuagaauuuguaccagggaggaauucacacgcaaaguucguuccaacgcagcuaucggggccguguuuguagaugagaaucaguggaacagcgcaaaggaagccguggaggacgagcgguucugggaucugguccauagagaaagggagcuccacaaacaaggaaagugcgcuacuugcguguauaauaugaugggcaaacgcgaaaagaagcugggugaguuugggaaagccaagggaucucgagcgaucugguacaugugguugggcgcacgguuccuggaauucgaggcccucggcuuuaugaacgaggaccauugguucucaagagaaaauagucuuuccgggguugagggagaaggucugcacaaauuaggcuacauucugagggauauaagcaagaucccagggggaaacauguaugcugacgauaccgccggcugggacacgcgcauuaccgaggaugacuugcagaaugaggcaaaaaucacagaaauuauggagcccgaacaugcucuccuggccacuucuaucuuuaagcuaaccuaccagaacaaaguggucagagugcagcggccugcuaagaacgguacaguaauggauguuauaucgaggcgugaccaacgagggucaggacaggugggcacuuauggccuuaauaccuucacgaacauggagguccagcugauccgccagauggaaagcgaggggauuuuucucccauccgagcuggaaacacccaauuuggccgagagaguguuagauuggcuggaaaagcacggagcagagcggcucaaaaggauggcgaucaguggugacgacuguguggucaagccgauugaugaccgcuucgccaccgcucuuacugcccugaacgauaugggcaaaguuagaaaggacaucccucaaugggaacccucuaaaggguggaaugauuggcagcaggugccauuuugcagccaccauuuccaccagcuaauaaugaaggacggacgggagauuguagugccuuguaggaaccaagaugagcuggucggccgagcacgugugucccagggugcuggguggucacucagagaaacagccugcuugggaaagaguuacgcacagauguggcaacugauguauuuucaucgccgggaccuuaggcuggccgcgaaugcuaucuguucugccguucccguggauugggucccaaccagcagaacuaccugguccauccacgcacaccaucaguggaugacaacggaggacaugcucucaguguggaaccgcguauggauugaagagaaucccuggauggaagauaaaacccacguuagcucuugggaggaggugccuuacuuaggcaagcgggaagaccaguggugcggcucccugauaggguugacugccagggcuacaugggccaccaacauccaggucgcaauuaaucaagugcgaagacugaucggaaacgagaauuaucucgacuacaugacuaguaugaaacgguucaagaacgaaagcgauccagagggugcucuuugguga

SEQ ID NO: 13359 - RNA, 9879 nt, Artificial Sequence
  derived and/or modified CDS sequence (opt3) from DENV-1__GU131981__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauuauggugggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguuuuuacgagcguggggaaauugguccaucagguguucggaaccgcauacggcguacucuuuuccggugugucuuggacuaugaagaucgggauuggcauacuguuaacauggcugggacuaaauagccggucaaccagucucuccaugacauguaucgcgguuggcauggucacucuguaccuuggggugauggugcaagcugacagcggaugcgucauuaacuggaaaggccgagaauugaagugugguucugggaucuucguuaccaacgaggugcacacguggacagaacaguauaaguuucaggccgauucaccgaaacgccugagugcagccaucggaaaggcuugggaggagggcgugugcgguauuagaagcgccaccaggcucgaaaauauaauguggaaacagaucuccaacgagcugaaucauauuuuacuggaaaacgacaugaaguucacuguagucgugggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguugaggauuauggcuucgguaucuuuaccacaaauauaugguugaagcucagagacagcuacacgcaaaugugcgaucacaggcugauguccgcugcaauuaaagacucaaaggccgugcaugcugauaugggguauuggaucgaaagugagaaaaacgaaaccuggaagcuagcccgugcaucuuucauugaggucaagacuuguacauggccaaaaagccacacccugugguccaauggagugcucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacgguugugguagacgagcacugcgggaaucgaggacccucuuuaagaacuaccacagucaccggcaagaucauucaugaaugguguugcagguccuguacucucccuccacugcgcuuccggggugaggaugggugcugguacggaauggagaucagacccgugaaagaaaaggaggaaaaccuugugaggaguauggucagcgccggcucuggugagguugacuccuuuucacugggcauauugugugcuaguauuaugaucgaagaggugaugcgcagccgauggucgcggaagaugcucaugacagggacccuggccguauuccuacugcucgugaugggacaacugacauggaaugaccuuauccguuugugcauuauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccaucggucugagcuugguggcuucagucgaacugccaaacaguuuagaggaacucggggacggacuggcgaugggcauuaugaugcuuaagcuguugacugaguuccagccccaccagcucuggauaacccugcuaucccugacauuuaucaaaacuacccuuucucucgauuacgccuggaagacgacagcaauggcucugagcauuguguccuuguucccgcuguguuuaucaaccacuagccagaaaacaaccuggcucccuguucugcuuggcaguuuugggugcaagccacugacuauguucuugaucacagaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggaccagccacaacauacucguugaagugcaggacgauggaacgaugaagauuaaagacgaggagcgagaugacacucugaccauccuucugaaggcaacauugcuagccgucuccggcguguacccaaugucaaucccugcuacccuguuuguaugguauuucuggcagaaaaagaagcagcgcaguggcgugcucugggauacacccagcccaccggaagucgagcgggcaguucuggacgaugggauuuacagaauacuucaaaggggauuacugggucguucucaggugggcgugggggucuuccaggacggaguguuucauacuauguggcacguuacccgcggcgccguacucauguaucaggguaaacgguuggaaccuuccugggcgucagugaagaaagaccugaucaguuacgggggaggcuggagauuccaaggcagcuggaauacgggggaggagguccaggugauugcuguugaacccggaaagaacccaaaaaaugugcagacaaugcccgguacuuuuaagaccccugagggcgaagucggggccaucgcacucgauuucaagccaggaacauccggcucucccauugugaacagggaggguaaaaucguagggcuguacggaaauggcgucgugaccacuucgggcaccuauguuagcgccauagcucaagccaaggcaucacaggaagggccucuuccggagaucgaggacgaaguguuuaaaaagcgaaaccugacaauuauggauuugcacccaggauccgguaaaacgcggcgcuaccuacccgcuauggucagagaggccaucaagaggaagcugcggacucucauuuuagcgccuacccgagugguugccagugaaauggcagaggcucugaaaggcaugccaaucagauaucagacaaccgccgugaagucugaacauacugggcgcgagauagucgaccuuaugugccacgcuacauucaccaugaggcugcucagccccgugcguguaccuaauuacaacaugauuaucauggaugaggcacauuuuacggacccggccuccaucgccgcucggggauauauuucaacuagagugggcaugggugaagcggcagccaucuucaugacagcuacccccccagggucuguugaggccuuuccucagagcaaugcagucauacaagaugaagagagggacauucccgaacgcaguuggaacuccggauacgauuggaucaccgacuucccaggcaaaacugugugguuugugccuagcauuaagucuggcaaugauaucgccaacuguuugcgaaaaaacgggaagagagucauacagcugucacggaagacauucgacaccgaguaucagaaaacaaagaauaacgacugggauuacguagugacuacggacauuuccgagaugggagcuaauuucagggcggaucgcguuaucgacccccguagaugccucaaaccagugauccugaaggaugguccggaacgggucauucuugccggcccuaugcccgugaccguugcaagugcugcccagaggcgcgggcgaaucggaagaaaccaaaauaaagagggcgaccaguacguguauaugggucagccacuaaacaaugaugaagaccacgcacauuggacagaggccaagaugcuguuggauaacauuaauacucccgaggggauaaucccugcuuuauuugaaccagagcgggaaaagagcgccgcgauugacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacaaaagaaggugagagaaagaaacucaggccucggugguuggacgcucgcaccuauagcgauccgcuggcccuaagagaguuuaaggaauucgcugcaggcaggcggucagucaguggggaccugauccucgagauuggaaaacuuccacagcaccugacuuuacgagcccagaaugcuuuggauaaccuggugaugcuccacaauucugaacagggcgguaaggccuacagacaugcaauggaggaacugcccgacacgauagagacccuuaugcugcucgcguugaucgccgugcugacagggggcgucacuuuauuuuuccuauccggaaagggccuggggaaaaccagcauuggacuccuuuguguuacagcuucaagugcccuguuguggauggcaagcguggagccucacuggaucgcugccuccauuauccuggaauuuuuccucaugguacugcuuauacccgagccagaucgccaaaggaccccucaggacaaccagcucgcauauguggucaucggucuguuguuuaugauucugacuguggccgcuaacgaaaugggcuuacuagagacaacgaagaaagaucuggggaucggacauguugcggccgagaaucaccaacacgcaaccaugcucgacguggaucuucggcccgcuucugccuggacucuguacgccgucgcaacaaccguaauuaccccaaugaugcgucauacaaucgaaaacacuacggcuaauauaagcuugaccgccauugcgaaccaggcugccauccugaugggccucgacaaggguuggccuauuuccaaaauggauaucggggugccgcugcuugcauuaggcugcuacucacagguuaauccccugacacucacugccgcuguguugaugcuggucgcacacuaugccauaaucggaccaggccuacaggcgaaggcuaccagagaggcccaaaagaggacagcagccgggauuaugaaaaacccuaccguggacggaaucgucgcuauugaucuggaccccgugguuuacgacgccaaguucgaaaaacagcucggccagaucaugcuucugauauuguguacuucucagauucugcucaugcgcacgacaugggcacugugcgagaguaucaccuuagcuacugguccacuuaccacacugugggaagggucgccuggaaaguuuuggaauacuaccaucgccgugagcauggcgaacauuuuccggggcuccuaucucgccggugcaggccuagcuuucucucugaugaaaucauuggggggaggccgaagagggacaggagcccaaggcgagacgcugggugagaaguggaagaggcagcucaaucagcuuagcaaauccgaauuuaacaccuacaagcgcagugggaucauggagguagaucggucugaagcaaaagagggacugaagagaggcgaaacuacaaaacaugcugugagccgugguaccgccaaguugaggugguucgucgagcggaaucugguuaagcccgagggcaaagugauagaccucggguguggacgcggcggguggucauauuacugcgccggauuaaagaaagucacugaagugaagggcuauacaaaaggugggccgggacacgaggaaccaauuccuauggcgaccuacggcuggaaccugguaaagcuucauuccggcaaagauguguuuuucaugcccccagagaagugugacacgcugcuaugcgauaucggggaaaguagccccaauccuaccauugaggagggacgaacacucagaguucugaagaugguggaaccgugguugagggguaaccaguuuuguaucaaaauacugaaucccuacaugccaucugucguggagacucucgaacaaaugcagcggaagcacggcgggaugcuuguccgcaacccucuguccagaaauucaacccacgagauguauugggugagcugcggaacaggcaacaucguuucggcuguaaacaugacuucuaggauguuacugaaucgauucaccauggcacaucggaaacccacauacgagcgugacguggauuugggugccgggaccagacacgucgcuguggaaccugagguugccaaccucgacauuaucggacagcgcauugaaaauaucaagaacgagcauaaaaguacuuggcacuaugaugaagacaauccauacaagacgugggcauaucacggcuccuacgaggugaagcccagcggcucagccuccucuauggucaacggggugguaaggcugcuaacaaaaccuugggaugugauuccaaugguuacccaaaucgcuaugacugacaccacacccuuuggacagcagcgggucuucaaggagaaaguggacacgagaaccccgcgcgcgaagagggguacuacacagauaauggaagugaccgccaaauggcuuuggggcuuucugagccgaaauaagaagccucggauuuguacuagagaggaauucacaaggaaaguccgcaguaacgcagcuaucggggccguuuuuguggaugagaaucaauggaacuccgcaaaggaagccguagaggacgagcguuucugggaucucgugcaucgggaaagagagcugcacaaacagggaaagugcgcuaccugcgucuauaauaugaugggcaaaagggaaaagaaguugggugaguuugggaaagccaagggaagccgcgcgaucugguacauguggcugggcgcacgauuccucgaauucgaggcccuuggcuuuaugaacgaggaccauugguucucucgggaaaauucacugagugggguggagggagaagguuuacacaaacugggcuacauuuugagagauauauccaagaucccagggggaaacauguaugcugacgauacagccggcugggacacuaggauuaccgaggaugaccuccagaaugaggcaaaaaucacggaaauuauggagcccgaacaugcucugcuagccaccagcaucuuuaagcuuacauaccagaacaaaguugugcgcguccaaagaccugcuaagaacgguacugugauggauguaauaucucggagggaccagcgugggucgggacagguuggcaccuauggccugaauacauucacuaacauggaggugcagcucauccgacaaauggaaucagaggggauuuuucugccaagcgaguuggaaacccccaauuuagccgagcgcguccuggauuggcucgaaaagcacggagcagagagacuuaaacggauggcgaucuccggugacgacuguguggugaagccgauugaugacagguucgccacggcucugacagcccuaaacgauaugggcaaaguccgcaaggacaucccucagugggaacccaguaaaggguggaaugauuggcagcagguuccauuuugcucucaccauuuccaccaacugauaaugaaggacggaagagagauugugguaccuugucggaaccaggaugagcucgugggcagggcacgagucagccagggugcugggugguccuugcgugaaaccgccugccugggaaagucauacgcacaaauguggcagcuuauguauuuucauagacgcgaccugcggcucgccgcgaaugcuaucuguagugccgugcccguugauugggugccaacuucuaggacaaccuggagcauccacgcacaccaucaguggaugacuaccgaggacauguuauccgucuggaacagaguguggauugaagagaaucccuggauggaagauaaaacacacguaucaagcugggaggagguuccuuaccugggcaagcgcgaagaccaguggugcggcucuuugauagggcugacggcccgggcuaccugggccacuaacauccaaguggcaauuaaucaggucaggcgacucaucggaaacgagaauuaucuugacuacaugacauccaugaaaagauucaagaacgaaagugauccagagggugcucugugguga

SEQ ID NO: 13360 - RNA, 9879 nt, Artificial Sequence
  derived and/or modified CDS sequence (opt3) from DENV-1__GQ868529__SS-prME
agcgugaccaugcugcucaugcuucugcccacagcauuggcuuuccacuuaacuacgagaggaggggaaccucauaugaucgucuccaagcaggaaaggggaaaaucucugcuguuuaagaccucagccgguguuaacaugugcacacucauugccauggaccugggcgagcuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcauuuuuccuggcccaugcuaucggcacaucgauuacccaaaagggcaucauauuuauccucuuaaugcuggugacgccaucaauggccaugcggugcgucgggauuggaaaccgcgauuucguggagggucuuagcggcgcgacuuggguagacguuguguuggagcacgggaguugugucacaaccauggcaaagaauaaacccacucuggauaucgaacuacucaagacagaggugaccaacccugccauucugagaaaacuuugcaucgaagcuaagauauccaauacgaccacagacucuagguguccaacucagggagaggccacccugguggaagaacaggaugcaaacuuugucugccggcgcacauucguugaccgaggcugggguaauggguguggauuguuuggcaaaggcagccuccugacuugcgcuaaguucaagugcgugaccaaauuagaggggaagacaguacaguacgaaaaccugaaauauuccgugauugucaccgugcacacuggagaucaacaucagguugguaaugagacgacagaacacggcaccaucgccacuauuaccccacaggcgccuacaucagagauccagcucaccgacuacggggcccuuacucuggacuguaguccaagaacaggauuggauuuuaacgaaauggugcuacugacgaugaaggagaaaagcuggcucguccauaagcaaugguuccuggaccuuccgcugcccuggaccucuggcgcauccacuucacaggagacauggaauaggcaggauuugcucgugaccuuuaaaacagcucacgccaagaagcaagaaguaguugugcuggguagccaggagggggcuaugcacacugccuuaaccggcgcaacggaaauccagaccaguggaacaacuaccauuuucgccggccaucugaaaugccggcuaaagauggacaaacucacacugaaggggacuucuuaugucauguguaccggauccuucaaacuugagaaggaaguggcugagacgcagcacgguacagucuuggugcaaguuaaguacgagggcaccgaugcgccuugcaaaauaccauuuagcacucaggacgaaaagggggugacacagaacggacgucugaucaccgcaaaucccauuguaacugauaaagagaagccugucaacaucgaaaccgagccacccuucggcgagucguauauagugguuggugccggggaaaaagcucucaagcugucuugguuuaagaaaggcuccucaauuggaaagauguucgaggccacagcacgcggcgccagaaggauggcuauccuuggggacacggccugggauuuuggaaguaucgguggcguguucaccagcgucgggaaacuggugcaucagguauuuggaacugcauacggcguguuguucuccgguguuucuuggacaaugaagauugggaucggcauucuccugaccugguuaggacugaauagccggucaacaagucuauccaugacuuguauagcggucggcauggugacccucuaccugggggugaugguccaagcugacagcggaugcguuaucaacuggaaaggccgagaacuuaagugugguucugggauuuuugugacgaacgaggugcacacauggaccgaacaguauaaguuccaggccgauucaccgaaacgcuugagugcagccaucggaaaggcuugggaggagggcguaugcgguaucagaagcgccacuaggcuggaaaauauuauguggaaacagauauccaacgagcucaaucauauccuguuagaaaacgacaugaaguuuaccgucgugguuggcgacgcaaaugggauucuggcucaaggcaagaagaugauccggccucagcccauggagcacaaauacucuuggaagucguggggcaaggccaaaauuaucggggcggauauacagaacacaacuuucaucauugacggaccagauaccccugaaugucccgacaaucagcgcgccuggaacaucugggagguggaggauuauggcuuugguauuuucacaacgaauaucuggcuuaaguugagagacagcuacacccaaaugugcgaucacaggcucauguccgcugcaauaaaagacucaaaggccguccaugcugauaugggguauuggauugaaagugagaaaaacgaaacuuggaagcuggcccgugcaucuuucaucgaggugaagacauguaccuggccaaaaagccacacucuaugguccaauggaguucuggaaucagagaugauuauccccaagauauacggcgguccuaucagccagcauaacuaucggccaggcuacuuuacacagauugcggggccguggcaccucggaaaacuggagcuugacuucgauuugugcgaaggcaccacggugguagucgacgagcacugcgggaaucgaggacccucucugagaacuaccacagugaccggcaagaucauucaugaaugguguugcagguccuguacuuuaccuccacuccgcuuucggggugaggaugggugcugguacggaauggagaucagacccgugaaagaaaaggaggaaaaccuggucaggaguaugguuagcgccggcucuggugagguggacuccuucucacuuggcauacugugugcuaguauuaugaucgaagagguaaugcgcagccgauggucgcggaagauguugaugacagggacccucgccguguuucugcuacuggucaugggacaacucacauggaaugaccugauccgucuuugcauuauggugggcgcaaacgcuuccgauagaauggggaugggaacuaccuauuuggcccugauggcaacguucaaaaugaggccuauguuugccguuggcuuacucuuccgccggcugacaucuagagaggugcuucugcuaaccaucggucucagccuggucgcuucaguggaauugccaaacagucuggaggaauuaggggacggacucgcgaugggcauuaugaugcugaaacuucugacugaguuucagccccaccaguuguggaccacacuccugucccuaacuuucauaaaaaccacgcugucucuugauuacgccuggaagacaaccgcaauggcucucagcaucguuucccuguuuccguugugucugucaacuacaagccagaaaaccacuugguuaccugugcuccugggcaguuucgggugcaagccacuuacaauguuucugauuaccgaaaauaagaucuggggaaggaaaucuuggcccuugaacgaggguauuauggccaucggcauagucuccauccuccugagcucgcuacugaagaaugacguaccucuugccgggccccucauugcuggaggcaugcugaucgcauguuaugugauuucagguucuagugccgauuuguccuuagagaaagcggcugaaguuagcugggagcaagaagccgagcauucugggacgagccacaacauccugguggaaguccaggacgauggaacuaugaagauaaaagacgaggagcgagaugacacccucacaauucugcuuaaggcaacccuguuggccguguccggcguauacccaaugucaaucccugcuacacuauucgugugguauuucuggcagaaaaagaagcagcgcaguggcguccugugggauacucccagcccaccggaaguugagcgggcagugcucgacgaugggaucuacaggauucugcaacgaggacuuuuaggucguucucaggugggcgucgggguguuucaggacggaguuuuccauaccauguggcacguaacgcgcggcgccgugcugauguaucaggguaaacggcucgaaccuuccugggcgucagucaagaaagacuugauaaguuacgggggaggcuggagauuucaaggcagcuggaauacaggggaggaggugcagguuaucgcuguggaacccggaaagaaccccaagaauguccagacuacccccgguacauucaagaccccugagggcgaagugggggccauugcacuggauuuuaagccaggaacuuccggcucucccaucguaaacagggaggguaaaauugucgggcucuacggaaauggcgugguuaccacaucgggcacguaugugagcgccaucgcucaagccaaggcaucacaggaagggccucugccggagauagaggacgaagucuucaaaaagcgaaaccuuacuaucauggaucugcacccaggauccgguaaaacccggcgcuacuugcccgcuauggugagagaggccauuaagaggaagcuacggacacugauccucgcgccuacccgaguuguggccagugaaauggcagaggcuuuaaaaggcaugccaauuagauaucagacuacagccgucaagucugaacauaccgggcgcgagaucguggaccugaugugccacgcuacguuuacuaugaggcuucugagccccguacgugugccuaauuacaacaugauaauuauggaugaggcacauuucacagacccggccuccaucgccgcucggggauauaucucaaccagaguuggcaugggugaagcggcagccauuuuuaugaccgcuacucccccagggucugucgaggccuucccucagagcaaugcagugauccaagaugaagagagggacauacccgaacgcaguuggaacuccggauacgauuggauuacagacuuuccaggcaaaaccgugugguucgucccuagcaucaagucuggcaaugauauugccaacugucucagaaagaacgggaaaagaguaauccaguugucacggaagacauucgacacugaguaucagaaaacgaagaauaacgacugggauuacgugguuaccacagacauauccgagaugggagcuaauuuuagggcggaucgcgugauugacccccguagaugccugaaaccagucauccucaaggaugguccggaacgggugauccuggccggcccuaugcccguuacuguggcaagugcugcccagaggcgcgggcgaauuggaagaaaccaaaauaaagagggcgaccaguacgucuauaugggucagccacuuaacaaugaugaagaccacgcacauuggaccgaggccaagaugcuacuggauaacaucaauacacccgaggggauuauaccugcuuuguucgaaccagagcgggaaaagagcgccgcgaucgacggcgaguacagguuacgcggagaagcaagaaaaaccuuuguggagcugaugaggcggggcgaucuccccguauggcugucguauaagguggccucugagggguuccaguacuccgaccgucgcuggugcuuugauggagaacgaaacaaucaaguucuugaggaaaacauggacgucgagauuuggacuaaagaaggugagagaaagaaacugaggccucgguggcucgacgcucgcacguauagcgauccguuggcccugagagaguucaaggaauuugcugcaggcaggcggucagugaguggggaccuaaugcuggagaucggaaaacucccacagcaccuuacccugcgagcccagaaugcuuuagauaacuuggugaugcugcacaauucugaacagggcgguaaggccuacagacaugcaauggaggaacuccccgacacaaucgagacucugaugcuucuggcgcucauugccgucuugaccgggggcguuacacuguucuuuuuauccggaaagggccuagggaaaaccagcauaggacugcucugugugacugcuucaagugcccuucuguggauggcaagcguagagccucacuggaucgcugccuccauuaucuuggaguucuuucugauggugcuccugauucccgagccagaucgccaaaggacaccucaggacaaccagcuugcauaugucgugaucggucuccuguucaugauauugacgguugccgcuaacgaaaugggccuguuagagaccacuaagaaagaucuagggaucggacauguggcggccgagaaucaccaacacgcaacaaugcuggacgucgaucuccggcccgcuucugccuggacccuuuacgccguagcaaccacagugauuacuccaaugaugcgucauacgaucgaaaacaccacagcuaauauuagccugacugccaucgcgaaccaggcugccauauugaugggccuggacaaggguuggccuauuuccaaaauggauaucgggguuccgcuccuggcacuuggcugcuacucacaggugaaucccuuaacccugacagccgcuguccucauguugguggcacacuaugccauuaucggaccaggccugcaggcgaaggcuaccagagaggcccaaaagaggacugcagccgggauaaugaaaaacccuacggucgacggaaucguggcuauugaucuagaccccguuguguacgacgccaaguuugaaaaacagcugggccagaucaugcuccuuauucuguguacaucucagaucuugcugaugcgcaccacuugggcacucugcgagaguauaacccuggcuacagguccauuaacuacccuuugggaagggucgccuggaaaguucuggaauacaacgauugccguaagcauggcgaacaucuuccggggcuccuaucuggccggugcaggccucgcuuuuucucuaaugaaaucacuagggggaggccgaagagggaccggagcccaaggcgagacuuugggugagaaguggaagaggcagcugaaucagcucagcaaauccgaguucaacacauacaagcgcagugggaucauggagguggaucggucugaagcaaaagagggacuuaagagaggcgaaaccacuaaacaugcugucagccgugguacagccaagcugaggugguuuguugagcggaauuuggugaagcccgagggcaaagucauugaccugggguguggacgcggcggguggucauauuacugcgccggacucaagaaagugaccgaaguaaagggcuauacgaaagguggguuaggacacgaggauccgaucccaauggcgaccuacggcuggaaccuggugaaacuucuggcuggcaaagacguuuucuuuaugccucccgaaaagugugauacacuacucugcgacauaggggaguccaguccaaaucccacuauugaagagggacgaacccugagaguguugaagauggucgagccuuggcugagggguaaccaguucuguaucaaaauucucaauccguacaugcccagcguggucgaaacacuugagcaaaugcagcggaagcauggcgggaugcuggugcgcaacccauuaucuagaaauuccacucacgaaauguauuggguuucaugcggaaccggcaacaucguaagcgcagugaacaugacaucgaggaugcuguugaaucgauuuaccauggcccaccggaaaccuacuuacgagcgugaugucgaccucggugcugggacgagacauguggccguugagcccgaaguggcaaaccuggauauaaucggacagcgcauugagaauaucaagaacgaacacaaaucuacauggcauuaugacgaggauaauccuuacaagaccugggccuaucacggcaguuacgaagucaagccauccggcagcgcuucauccauggugaacgggguagugaggcuacuuacuaaacccugggacguuauuccuauggucacccaaaucgcgaugacagacacgaccccauucggacagcagcggguguuuaaggagaaaguggauacuagaacaccccgcgccaagagggguaccacucagauuauggaggucacagcaaaauggcuguggggcuuccucucucgaaauaagaagccgcggaucuguaccagagaagaguuuacaaggaaaguucgcagcaacgcugccauaggggcaguguucguagacgaaaaucaauggaacagugccaaggaggcuguggaagaugagcguuuuugggaccugguccaccgggagagagaauugcauaaacagggaaagugcgccacuugcguguauaauaugaugggcaaaagggagaagaagcugggugaguucgggaaagcgaagggaucccgcgcaauuugguacauguggcucggcgcccgauuccuugaguuugaagcucugggcuucaugaacgaggaucacugguuuagccgggaaaauucuuuaucagggguugaaggagagggucugcauaaauugggcuacauccucagagacaucaguaagauuccugggggaaacauguaugccgaugacaccgcaggcugggauacgaggauaaccgaagacgaucugcagaaugaggcuaaaaucacagagauuauggaaccagagcacgcccuacuugcuacuuccaucuucaagcugaccuaccagaacaaagugguccgcgugcaaagacccgccaagaacgguacaguaauggacguuauuagccggagggaucagcgugggucuggacaggugggcacuuauggccucaauaccuuuacgaacauggaaguccagcugauccgacaaauggagucggaagggauauucuugccuucagaguuagagacaccaaaucuggcagaacgcgugcucgacuggcuugagaagcauggagcggaaagacugaaacggauggccaucagcggugacgauuguguggucaagcccauugacgauagguuugcuaccgcccuaacugcacugaacgacaugggcaaaguucgcaaggauaucccgcagugggagccuuccaaaggguggaaugacuggcaacaggugcccuucugcagucaccacuuucaucaacucauuaugaaggauggaagagaaaucguagugccaugucggaaccaggacgaguuggucggcagggcucgagugucucagggugccggguggagccugcgugagacagcaugccuuggaaaguccuacgcccaaauguggcagcugauguauuuccacagacgcgaucuccgguuagcggcuaaugccauauguucagcaguuccuguggacuggguccccaccaguaggacuaccuggucuauucaugcccaccaccaguggaugacaacggaagauaugcugagcguguggaacagaguauggaucgaggaaaauccauggauggaggacaaaacccauguuuccucaugggaagaggugcccuacuugggcaagcgcgaggaccaguggugcggcagccugaucgggcucacugcucgggccacaugggcaaccaacauucaagucgcuauaaaucaggugaggcgacuuaucggaaacgaaaauuaucuggauuacaugacuucuaugaaaagauuuaagaacgaguccgacccugaaggugcccuaugguga

SEQ ID NO: 13361 - RNA, 9879 nt, Artificial Sequence
  derived and/or modified CDS sequence (opt3) from DENV-1__GQ868531__SS-prME
agcgugaccaugcugcucaugcuucugccaacagcauuggcuuuccacuuaacuacgagaggaggggaaccucauaugauagucuccaagcaggaaaggggaaaaucucuguuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuacaggauucuucaacgaggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaagaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaucgggcacguaugucagcgcaaucgcccaagcuaaggccucacaggaagggccucuuccggagauagaggacgaaguguuuaaaaagcgaaaccugacuaucauggauuugcacccaggauccgguaaaacccggcgcuaccuacccgcaauuguuagagaggcuaucaagaggaagcugcggacacucauuuuagccccuacccgaguggucgcgagugaaauggccgaggcacugaaaggcaugccaaucagauaucagacuacagcugugaagucugaacauaccgggcgcgagauaguagaccuuaugugccacgccacguucacuaugaggcugcucagccccgugcguguuccuaauuacaacaugauuaucauggaugaggcucauuuuacagacccggcauccaucgccgcccggggauauauuucaaccagagucggcaugggugaagcugcggcaaucuucaugaccgccacucccccagggucuguggaggcuuuuccucagagcaaugccgugauacaagaugaagagagggacauucccgaacgcaguuggaacuccggauacgauuggaucacagacuucccaggcaaaaccgucugguuuguaccuagcauuaagucuggcaaugauaucgcaaacuguuugagaaagaacgggaagagagugauacagcugucacggaagacauucgacacugaguaucagaaaacgaagaauaacgacugggauuacguugugaccacagacauuuccgagaugggagccaauuucagggcugaucgcgucaucgacccccguagaugccucaaaccagugauccugaaggaugguccggaacggguuauucuugcgggcccuaugcccgugacugucgccagugcagcucagaggcgcgggcgaaucggaagaaaccaaaauaaagagggcgaccaguacguguauaugggucagccacuaaacaaugaugaagaccacgcccauuggaccgaggcaaagaugcuguuggauaacauuaauacacccgaggggauaaucccugccuuauuugaaccagagcgggaaaagagcgcugccauugacggcgaguacaggcugcgcggagaagcgagaaaaaccuucguagagcucaugaggcggggcgaucugcccguguggcuuucguauaagguugcaucugagggguuucaguacuccgaccgucgcuggugcuucgauggagaacgaaacaaucaaguccuggaggaaaacauggacguggagaucuggacuaaagaaggugagagaaagaaacucaggccucggugguuggacgcccgcacguauagcgauccgcuggcucuaagagaguuuaaggaguucgccgcuggcaggcggucagugaguggggaccugauccucgagauuggaaaacuuccacagcaccugaccuuacgagcacagaaugccuuggauaaccuggucaugcuccacaauucugaacagggcgguaaggcuuacagacaugccauggaggaacugcccgacacaauagagacucuuaugcugcucgcauugaucgcgguucugaccgggggcgugacauuauuuuuccuauccggaaagggccuggggaaaaccagcauuggacuccuuuguguaacugccucaagugcucuguuguggauggccagcguggagccucacuggaucgcagcuuccauuauccuggaauuuuuccucaugguccugcuuauacccgagccagaucgccaaaggacaccucaggacaaccagcucgccuaugugguuaucggucuguuguuuaugauucugacgguggcagccaacgaaaugggcuuacuagagaccacuaagaaagaucuggggaucggacaugucgcugcggagaaucaccaacacgccacaaugcucgacguagaucuucggcccgcaucugcuuggacccuguacgccguggccaccacaguuauuacuccaaugaugcgucauacgaucgaaaacaccacagcaaauaucagcuugacugcuauugccaaccaggcggcuauccugaugggccucgacaaggguuggccuauuuccaaaauggauaucggggugccgcugcuugccuuaggcugcuacucacaggucaauccccugacccucacagcagccguguugaugcuggucgcucacuaugcaauaaucggaccaggccuacaggccaaggcgaccagagaggcucaaaagaggacugccgcagggauuaugaaaaacccuacgguggacggaaucguugccauugaucuggaccccgugguauacgacgcuaaguucgaaaaacagcucggccagaucaugcuucugauauuguguacaucucagauucugcucaugcgcaccacuugggcccugugcgagaguaucaccuuagcaacagguccacuuacuacccugugggaagggucgccuggaaaguuuuggaauacaacgaucgcugugagcauggccaacauuuuccggggcuccuaucucgcgggugccggccuagcauucucucugaugaaaucacuagggggaggccgaagagggaccggagcucaaggcgagacucugggugagaaguggaagaggcagcucaaucagcuuagcaaauccgaauuuaacacauacaagcgcagugggaucauggaggucgaucggucugaagccaaagagggacugaagagaggcgaaaccacuaaacaugcaguuagccgugguacagcuaaguugaggugguucguggagcggaaucuggucaagcccgagggcaaagugauagaccucggguguggacgcggcggguggucauauuacugcgccggauuaaagaaaguaaccgaagugaagggcuauacgaaaggugggccgggacacgaggaaccaauuccuauggccaccuacggcuggaaccugguuaaacuucauuccggcaaagauguguuuuucaugcccccagagaagugugacacacugcuaugcgauaucggggaaaguagccccaauccuacuauugaggagggacgaacccucagaguccugaagaugguggaaccgugguugagggguaaccaguuuuguaucaaaauacugaaucccuacaugccaucugucguggaggcgcucgaacaaaugcagcggaagcacggcgggaugcuuguucgcaacccucuguccagaaauucaacacacgagauguauuggguaagcugcggaacuggcaacaucgugucggcugucaacaugaccucuaggauguuacugaaucgauucacaauggcacaucggaaacccaccuacgagcgugacguggauuugggugccgggacuagacacguugcuguggaaccugaggucgccaaccucgacauuaucggacagcgcauugaaaauaucaagaacgagcauaaaaguacguggcacuaugaugaagacaauccauacaagacaugggcauaucacggcuccuacgaggugaagcccagcggcucagccuccucuaugguaaacggggugguuaggcugcuaaccaaaccuugggaugucauuccaauggugacucaaaucgcuaugaccgacacaacgcccuuuggacagcagcggguguucaaggagaaagucgacaccagaacuccgcgcgcgaagagggguacaacccagauaauggaaguuacugccaaauggcuuuggggcuuucugagccgaaauaagaagccucggauuuguacaagagaggaguucaccaggaaagugcgcaguaacgcagcuaucggggccguauuuguggaugagaaucaauggaacuccgcaaaggaagccgucgaggacgagcguuucugggaucucgugcaucgggaaagagagcugcacaaacagggaaagugcgcuacaugcguuuauaauaugaugggcaaaagggaaaagaaguugggugaguuugggaaagccaagggaagccgcgcgaucugguacauguggcugggcgcacgauuccucgaguucgaggcccuuggcuuuaugaacgaggaccauugguucucucgggaaaauucacugagugggguggagggagaagguuuacacaaacugggcuacauuuugagagauauauccaagaucccagggggaaacauguaugcugacgauacugccggcugggacaccaggauuacggaggaugaccuccagaaugaggcaaaaaucaccgaaauuauggagcccgaacaugcucugcuagccacaagcaucuuuaaacuuacuuaccagaacaaagucgugcgcguacaaagaccugcuaagaacgguaccguuauggaugugauaucucggagggaccagcgugggucgggacaggucggcacauauggccugaauacuuucaccaacauggaggugcagcucauccgacaaauggaaucagaggggauuuuucugccaagcgaguuggaaacgcccaauuuagccgagcgcgugcuggauuggcucgaaaagcacggagcagagagacuuaaacggauggcgaucuccggugacgacugugucguuaagccgauugaugacagguucgccacagcucugaccgcccuaaacgauaugggcaaagugcgcaaggacaucccucagugggaacccaguaaaggguggaaugauuggcagcagguaccauuuugcucucaccauuuccaccaacugauaaugaaggacggaagagagauuguggucccuugucggaaccaggaugagcucgugggcagggcacgaguuagccagggugcugggugguccuugcgugaaacugccugccugggaaagucauacgcacaaauguggcagcuuauguauuuucauagacgcgaccugcggcucgccgcgaaugcuaucaguucugccgugcccgucgauugggugccaacaagcaggaccacuugguccauccacgcacaccaucaguggaugaccacagaggacauguuaucaguauggaacagaguuuggauugaagagaaucccuggauggaagauaaaacgcacgugagcucuugggaggaggucccuuaccugggcaagcgcgaagaccagugguguggcuccuugauagggcugaccgcccgggcuacuugggccacaaacauccaaguggcaauuaaucagguuaggcgacucaucggaaacgagaauuaucuugacuacaugaccaguaugaaaagauucaagaacgaaagcgauccagagggugcucugugguga

SEQ ID NO: 13362 - RNA, 9879 nt, Artificial Sequence
  derived and/or modified CDS sequence (opt3) from DENV-1__GU131983__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugaucgggacacuggccguguuccuacugcucgucaugggacaacugaccuggaaugaccuuauucguuugugcaucauggugggcgcaaacgcuuccgauagaauggggaugggaacaacuuaucuggccuuaauggcaaccuuuaaaaugaggccuauguucgccguuggccuccuguuucgccggcuuacgucuagagaggugcugcuacucacaauuggucugagcuuggucgcuucaguggaacugccaaacaguuuagaggaacucggggacggacuggcgaugggcauaaugaugcuuaagcuguugaccgaguuccagccccaccagcucuggacuacccugcuaucccugacauuuaucaaaacuacccuuucucucgauuacgccuggaagacgacagcaauggcucugagcauuguuuccuuguucccgcuguguuuaucaaccacuagccagaaaacaaccuggcucccugugcugcuuggcaguuuugggugcaagccacugacuauguucuugaucacagaaaauaagauuuggggaaggaaaucuuggccccucaacgaggguaucauggccauaggcaucgucuccauucugcuaagcucgcugcuuaagaaugacguaccucucgccgggccccugaucgcuggaggcauguugauugcauguuaugugaucucagguucuagugccgauuuaucccuggagaaagcggcugaaguuagcugggagcaagaagccgagcauucugggaccagccacaacauacucguggaaguccaggacgauggaacgaugaagauuaaagacgaggagcgagaugacacucugaccauccuucugaaggcaacauugcuagccguguccggcguauacccaaugucaaucccugcuacccuguuugugugguauuucuggcagaaaaagaagcagcgcaguggcguccucugggauacacccagcccaccggaaguugagcgggcagugcuggacgaugggauuuacagaauacuucaaaggggauuacugggucguucucaggugggcgucgggguguuccaggacggaguuuuucauacuauguggcacguaacccgcggcgccgugcucauguaucaggguaaacgguuggaaccuuccugggcgucagucaagaaagaccugaucaguuacgggggaggcuggagauuccaaggcagcuggaauacgggggaggaggugcagguuauugcuguggaacccggaaagaacccaaaaaauguccagacaacucccgguaccuuuaagacaccugagggcgaagugggggccaucgcacucgauuucaagccaggaaccuccggcucucccauuguaaacagggaggguaaaaucgucgggcuguacggaaauggcgugguuacuaccucgggcacauaugugagcgccauagcucaagccaaggcaucacaggaagggccucuuccggagaucgaggacgaagucuuuaaaaagcgaaaccugacgauuauggauuugcacccaggauccgguaaaacucggcgcuaccuacccgcuaucgugagagaggccauuaagaggaagcugcggacccucaucuuagcgccuacacgaguuguggccagugaaauggcagaggcucugaaaggcaugccaauaagauaucagaccacugccgucaagucugaacauacagggcgcgagauuguggaccuuaugugccacgcuaccuucacgaugaggcugcucagccccguacgugugccuaauuacaacaugaucaucauggaugaggcacauuuuacugacccggccuccauugccgcucggggauauaucucaacaagaguuggcaugggugaagcggcagccauauucaugaccgcuacccccccagggucugucgaggccuuuccucagagcaaugcagugauucaagaugaagagagggacauccccgaacgcaguuggaacuccggauacgauuggauuacugacuucccaggcaaaacagugugguuugucccuagcaucaagucuggcaaugauauagccaacuguuugcgaaaaaacgggaagagaguaauucagcugucacggaagaccuucgacacagaguaucagaaaacuaagaauaacgacugggauuacgugguuacgaccgacaucuccgagaugggagcuaauuucagggcggaucgcgugaucgacccccguagaugccucaaaccagucauucugaaggaugguccggaacgggugauccuugccggcccuaugcccguuacaguggcaagugcugcccagaggcgcgggcgaauuggaagaaaccaaaauaaagagggcgaccaguacgucuauaugggucagccacuaaacaaugaugaagaccacgcacauuggacugaggccaagaugcuguuggauaacauaaauacccccgaggggaucauuccugcuuuauuugaaccagagcgggaaaagagcgccgcgaucgacggcgaguacaggcugcgcggagaagcaagaaaaacauucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagaucuggaccaaagaaggugagagaaagaaacucaggccucggugguuggacgcucgcacuuauagcgauccgcuggcccuaagagaguuuaaggaauucgcugcaggcaggcggucagugaguggggaccugauucucgagauaggaaaacuuccacagcaccugacguuacgagcccagaaugcuuuggauaaccuggugaugcuccacaauucugaacagggcgguaaggccuacagacaugcaauggaggaacugcccgacaccaucgagacacuuaugcugcucgcguugauugccguccugacugggggcguuaccuuauuuuuccuauccggaaagggccuggggaaaacaagcaucggacuccuuugugugaccgcuucaagugcccuguuguggauggcaagcguagagccucacuggauugcugccuccaucauacuggaauuuuuccucauggugcugcuuauccccgagccagaucgccaaaggacuccucaggacaaccagcucgcauaugucgugauuggucuguuguuuaugauccugacaguugccgcuaacgaaaugggcuuacuagagacgaccaagaaagaucuggggauuggacauguggcggccgagaaucaccaacacgcaacuaugcucgacgucgaucuucggcccgcuucugccuggacacuguacgccguagcaaccaccgugaucacaccaaugaugcgucauacuauagaaaacacgaccgcuaauauuagcuugacagccaucgcgaaccaggcugccauucugaugggccucgacaaggguuggccuaucuccaaaauggauauagggguuccgcugcuugcauuaggcugcuacucacaggugaauccccugacucucaccgccgcugucuugaugcugguggcacacuaugccaucauuggaccaggccuacaggcgaaggcuacaagagaggcccaaaagaggaccgcagccgggaucaugaaaaacccuacugucgacggaauuguggcuaucgaucuggaccccguuguguacgacgccaaguucgaaaaacagcucggccagauaaugcuucugauuuuguguacgucucagauccugcucaugcgcacaaccugggcacugugcgagaguaucacuuuagcuaccgguccacuuacaacucugugggaagggucgccuggaaaguuuuggaauaccacaauugccguaagcauggcgaacaucuuccggggcuccuaucucgccggugcaggccuagcuuucucucugaugaaaucauuggggggaggccgaagagggacgggagcccaaggcgagacccugggugagaaguggaagaggcagcucaaucagcuuagcaaauccgaauuuaacacuuacaagcgcagugggauaauggagguggaucggucugaagcaaaagagggacugaagagaggcgaaacaaccaaacaugcugucagccgugguacugccaaguugaggugguucguugagcggaaucuggugaagcccgagggcaaagucauugaccucggguguggacgcggcggguggucauauuacugcgccggauuaaagaaagugacagaaguaaagggcuauaccaaaggugggccgggacacgaggaaccaaucccuauggcgacguacggcuggaaccuggugaagcuucauuccggcaaagauguuuuuuucaugcccccagagaagugugacacccugcuaugcgauauuggggaaaguagccccaauccuacaaucgaggagggacgaacucucagagugcugaagauggucgaaccgugguugagggguaaccaguuuuguauaaaaauccugaaucccuacaugccaucuguggucgagacccucgaacaaaugcagcggaagcacggcgggaugcuugugcgcaacccucuguccagaaauucaacacacgagauguauuggguuagcugcggaacuggcaacauuguaucggcugugaacaugaccucuaggauguuacugaaucgauucacaauggcacaucggaaacccaccuacgagcgugacgucgauuugggugccgggacuagacacguggcuguugaaccugagguggccaaccucgacaucauuggacagcgcaucgaaaauauuaagaacgagcauaaaaguacguggcacuaugaugaagacaauccauacaagacaugggcauaucacggcuccuacgaggucaagcccagcggcucagccuccucuauggugaacgggguagugaggcugcuaaccaaaccuugggauguuaucccaauggucacucaaauagcuaugaccgacacaacgcccuuuggacagcagcggguguucaaggagaaaguggacaccagaacuccgcgcgcgaagagggguacaacccagauuauggaagucacugccaaauggcuuuggggcuuucugagccgaaauaagaagccucggaucuguacaagagaggaauucaccaggaaaguucgcaguaacgcagcuaucggggccguguuuguagaugagaaucaauggaacuccgcaaaggaagccguggaggacgagcguuucugggaucucguccaucgggaaagagagcugcacaaacagggaaagugcgcuacaugcguguauaauaugaugggcaaaagggaaaagaaguugggugaguuugggaaagccaagggaagccgcgcgauuugguacauguggcugggcgcacgauuccucgaauucgaggcccuuggcuuuaugaacgaggaccauugguucucucgggaaaauucacugagugggguugagggagaagguuuacacaaacugggcuacauauugagagauaucuccaagauuccagggggaaacauguaugcugacgauacugccggcugggacaccaggaucacggaggaugaccuccagaaugaggcaaaaauuaccgaaaucauggagcccgaacaugcucugcuagccacaagcauauuuaagcuuacuuaccagaacaaagugguccgcgugcaaagaccugcuaagaacgguaccguaauggauguuaucucucggagggaccagcgugggucgggacaggugggcacauauggccugaauacuuucaccaacauggagguccagcucauucgacaaauggaaucagaggagaucuuucugccaagcgaauuggagacgcccaauuuagccgaacgcgugcuggauuggcucgagaagcacggggcagaaagacuuaaacggauggcgauuuccggagacgacuguguggucaagccgaucgaugacagguucgccacagcucugaccgcccuaaacgauauggguaaaguucgcaaggacauaccucagugggagcccaguaaaggcuggaaugauuggcagcaggugccauuuugcucucaccauuuccaccaacugauuaugaaggacgggagagagaucguagugccuugucggaaccaggaugaacucgucggaagggcacgagugagccagggcgcugguugguccuugcgugagacugccugccuggggaagucauacgcacaaauguggcagcuuauguauuuucauagacgcgaccugcggcucgccgcgaaugcuaucuguagugccguucccguggauugggucccaacaucuaggaccacuuggagcauucacgcacaccaucaguggaugaccacagaagacauguuauccguguggaacagaguauggauagaggaaaaucccuggauggaggauaaaacgcacguuucaagcugggaggaagugccuuaccugggaaagcgcgaggaccaguggugcggcucuuugaucggccugaccgcccgggcuacuugggccacaaacauucaagucgcaaucaaucaggugaggcgacucauugggaacgaaaauuaucuugacuacaugaccuccaugaaaagauucaagaacgagagugauccagagggagcucugugguga

SEQ ID NO: 13363 - RNA, 9879 nt, Artificial Sequence
  derived and/or modified CDS sequence (opt3) from DENV-1__GQ868532__SS-prME
agcgugaccaugcugcucaugcuucugcccacagccuuggcuuuccacuuaacuacgcgaggaggggaaccucauaugaucgucuccaagcaggaaaggggaaaaucucugcuguuuaagaccucagcugguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucgucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggauaacccugcuaucccugacauuuaucaaaacuacccuuucucucgauuacgccuggaagacgacagcaauggcucugagcauuguuuccuuguucccgcuguguuuaucaaccacuagccagaaaacaaccuggcucccugugcugcuuggcaguuuugggugcaagccacugacuauguucuugaucacagaaaauaagauuuggggaaggaaaucuuggccccucaacgaggguaucauggccauaggcaucgucuccauucugcuaagcucgcugcuuaagaaugacguaccucucgccgggccccugaucgcuggaggcauguugauugcauguuaugugaucucagguaacucugccgauuuaagucuggagaaagcggcugaaguuuccugggagcaagaagccgagcauagcgggaccucucacaauauacucguggaaguccaggacgauggaacgaugaagauuaaagacgaggagcgagaugacacucugaccauccuucugaaggcaacauugcuagccgugagcggcguauacccaauguccaucccugcuacccuguuugugugguauuucuggcagaaaaagaagcagcgcucaggcguccucugggauacacccaguccaccggaaguugagcgggcagugcuggacgaugggauuuacagaauacuucaaaggggauuacugggucguagccaggugggcgucgggguguuccaggacggaguuuuucauacuauguggcacguaacccgcggcgccgugcucauguaucaggguaaacgguuggaaccuucuugggcguccgucaagaaagaccugaucucauacgggggaggcuggagauuccaaggcaguuggaacacgggggaggaggugcagguuauugcuguggaacccggaaagaaucccaaaaacguccagacaaugcccgguacuuuuaagaccccugagggcgaagugggggccaucgcacucgauuucaagccaggaacaagcggcucccccauuguaaauagggaggguaaaaucgucgggcuguacggaaacggcgugguuaccacuucuggcaccuaugugucggccauagcucaagccaaggcaagccaggaagggccuccgccagagaucgaggacgaagucuuuaaaaagcgaaaucuuacaauuauggaucugcaccccggaucagguaaaacgcggcgcuacuugccugcuauggugagagaggccaucaagaggaagcuacggacucugauucucgcgccaacccgaguuguggccuccgaaauggcagaggcuuuaaaaggcaugcccaucagauaucagacaaccgccgucaagagugaacauacugggcgcgagauaguggaccugaugugccacgcuacauucaccaugaggcuucugucuccuguacgugugccgaacuacaauaugauuaucauggaugaggcacauuuuacggaccccgccagcaucgccgcucggggauauauuuccacuagaguuggcaugggugaagcggcagccaucuucaugacagcuaccccaccugggucagucgaggccuuuccccagucuaacgcagugauacaagaugaagagagggacauuccagaacgcagcuggaauaguggauacgauuggaucaccgacuucccuggcaaaacugugugguuuguccccuccauuaagagcggcaacgauaucgccaacugucuccggaaaaaugggaagagaguaauacaguugucuagaaagacauucgacaccgaguaucagaaaacaaagaacaaugacugggauuacgugguuacuacggacauuucagagaugggagcuaacuucagggcggaucgcgugaucgacccacguagaugccugaaaccggucauccucaaggaugguccugaacgggugauucuggccggccccaugccaguuaccguggcauccgcugcccagaggcgcgggcgaaucggaagaaaucaaaacaaagagggcgaccaguacgucuauaugggucagccccuuaauaacgaugaagaccacgcacauuggacagaggccaagaugcuacuggauaauauuaacacuccugaggggauaaucccagcuuuguuugaacccgagcgggaaaagagugccgcgauugacggcgaguacagguuacgcggagaagcaagaaaaaccuucguggagcugaugaggcggggcgaucucccuguauggcugagcuauaagguggccucggagggguuucaguacucugaccgucgcuggugcuucgauggagaacgaaauaaccaaguucuugaggaaaauauggacgucgagaucuggacaaaagaaggugagagaaagaaacugaggccgcgguggcucgacgcucgcaccuauuccgauccauuggcccugagagaguuuaaggaguucgcugcaggcaggcggagcgugucaggggaccuaauccuggagauuggaaaacucccccagcaccuuacucugcgagcccagaacgcuuuagauaauuuggugaugcugcacaacagugaacagggcgguaaggccuacagacaugcaauggaggaacucccugacacgauagagacccugaugcuucugacacucaucgcggucuugacugggggcguuacccuguuuuucuuaucuggaaagggccuagggaaaacauccauuggacugcucugugugaccgccagcucagcacuucuguggauggccaguguagagccccacuggaucgcagcuagcauuaucuuggaauuuuuccugauggugcuccugauaccagagccugaucgccaaaggacuccccaggacaaccagcuugccuaugucgugaucggucuccuguuuaugauuuugacaguugcagccaaugaaaugggccuguuagagacgaccaagaaagaucuagggaucggacauguggcugcggagaaccaccaacacgccacuaugcuggacgucgaucuccggccagcauccgcuuggacacuuuacgccguagccaccaccgugauuacaccuaugaugcgucauacuaucgaaaauacgaccgcaaacauaucucugacagcuauugccaaucaggcggcuaucuugaugggccuggacaaggguuggccgauuagcaaaauggauaucgggguuccccuccuggcccuuggcugcuacucccaggugaacccauuaacucugaccgcagccguccucauguugguggcucacuaugcaauaaucggaccuggccugcaggccaaggcgacaagagaggcucaaaagaggaccgccgcagggauuaugaaaaaucccacugucgacggaaucguggccauugaucuagacccaguuguguacgacgcuaaguucgaaaaacagcugggccagaucaugcuccuuauacuguguacgucacagauuuugcugaugcgcacaaccugggcccucugcgagucuaucacucuggcaaccgguccuuuaacaacucuuugggaagggagucccggaaaguuuuggaacaccacaaucgcuguaucgauggccaauauuuuccggggcagcuaucuggcgggugccggccucgcauucucccuaaugaaaucucuagggggaggccgaagagggacgggagcucaaggcgagaccuugggugagaaguggaagaggcagcugaaccagcucucaaaaagcgaauuuaauacuuacaagcgcuccgggaucauggagguggaucggagugaagccaaagagggacuuaagagaggcgaaacaaccaaacaugcagucucucgugguacugcuaagcugaggugguucguugagcggaacuuggugaagccggagggcaaagucauagaccugggguguggacgcggcggguggagcuauuacugcgccggacucaagaaagugacagaaguaaagggcuauaccaaaggugggccaggacacgaggaaccuauucccauggccacguacggcuggaauuuagugaagcugcauucaggcaaagauguauuuuucaugccacccgagaagugugacacccuucugugcgauaucggggaauccaguccuaacccgacaauugaggagggacgaacucuaagagugcucaagauggucgaacccuggcugagggguaaucaguuuuguaucaaaauauugaacccauacaugccuaauguggucgagacccuggaacaaaugcagcggaagcacggcgggaugcucgugcgcaacccccuuagcagaaacucuacacacgagauguauuggguuuccugcggaacuggcaauaucguaucagcggugaacaugaccagcaggaugcuguuaaaucgauucacaauggcucaucggaaaccuaccuacgagcgugacgucgaucugggugcagggacuagacacguggccguugaaccagagguggcuaacuuggacauuaucggacagcgcauugaaaauaucaagaacgagcauaaaucgacguggcacuaugaugaagacaaucccuacaagacaugggccuaucacggcucuuacgaggucaagccuaguggcuccgcaagcucaauggugaacgggguagugaggcuccugaccaaaccaugggaugguauuccaaugguuacucaaaucgccaugaccgacacaacgccguuuggacagcagcgggucuucaaggagaaaguggacaccagaacuccucgcgcuaagaggggcacaacccagauaauggaagugacugcgaaauggcuauggggguuucuuucccgaaauaagaagccacggauuuguacaagagaggaguucaccaggaaaguccgcucuaacgccgcaaucggagcuguuuuuguggaugagaaucaauggaacagcgccaaggaagcaguagaggacgagcguuucugggaucuggugcaucgggaaagagagcuccacaaacagggcaagugcgccacaugcgucuauaauaugauggguaaaagggaaaagaagcugggggaguuuggaaaagcuaagggcagucgcgccaucugguacaugugguugggcgcgcgauuccuggaguucgaggcacucggguuuaugaacgaggaccauugguucucccgggaaaauagccuuucuggaguggagggugaaggccugcacaaauuaggguacauucugagagauauaucaaagauccccggaggcaacauguaugccgacgauacugcugguugggacaccaggauuacggaggaugacuugcagaacgaggccaaaaucaccgaaauuauggagccugaacaugcacuccuggcuacaaguaucuuuaagcuaacuuaccagaauaaaguugugcgcguccaaagaccagccaagaacgggaccgugauggauguaauaucccggagggaccagcguggaagcggccagguuggcacauaugggcuuaauacuuucaccaacauggaggugcagcugauccgacaaauggaaucugagggaauuuuucuccccucggagcuggaaacgccgaauuuggcugagcgcgucuuagauuggcuggaaaagcacggugccgagagacucaaacggauggcaaucucaggcgacgacuguguggugaagccuauugaugacagguucgcgacagcccuuaccgcucugaacgauauggggaaaguccgcaaggacaucccccagugggaaccaagcaaaggauggaaugauuggcagcagguuccuuuuugcucccaccauuuccaccaacuaauaaugaaggacggcagagagauugugguacccugucggaaccaggaugagcugguggguagggcccgagucagucagggggcaggauggucucuccgugaaacugcuugcuugggcaagagcuacgcccaaauguggcagcugauguauuuucauagacgcgaccuucggcuggcagccaaugcgaucuguuccgcugugccaguugauugggugcccacaucaaggaccacuuggaguauccacgcccaccaucaguggaugaccacagaggacaugcucucugucuggaacagaguguggauugaagagaauccuuggauggaagauaaaacgcacguaagcuccugggaggagguuccauacuuaggcaagcgcgaagaccaguggugcgggucacugauaggauugaccgcacgggccacuugggcuacaaacauccaaguggccauuaaucaggucaggcgacugaucgguaacgagaauuaucucgacuacaugaccagcaugaaaagauucaagaacgaaucugauccggagggcgcacuuugguga

SEQ ID NO: 13364 - RNA, 9879 nt, Artificial Sequence
  derived and/or modified CDS sequence (opt3) from DENV-1__GQ868533__SS-prME
agcgugaccaugcugcucaugcuucugccaacagcauuggcuuuccacuuaacuacgcgaggaggggagccucauaugaucgucuccaagcaggaaaggggaaaaucucugcuauuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaggaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaaaaugauucggccucagcccauggagcacaaauacucuuggaagucguggggcaaggccaaaaucauagaagcggauauccagaacaccacauuuauuaucgacgggccagauacuccugagugucccgacaaucagcgcgccuggaacauuugggagguggaagauuauggauucggcaucuuuaccacaaauauaugguugaagcucagagacagcuacacgcaaaugugcgaucacaggcugauguccgcugcaauuaaagacucaaaggccguccaugcugauauggguuauuggaucgagagugagaagaacgagaccuggaagcuagcccgugcaucuuucauugaagugaagacuuguacauggccaaaaagccacacccugugguccaaugggguucucgagucagagaugaucauacccaagaucuacggaggcccuauuagccagcauaacuaucggccagguuacuucacucagacagcgggcccguggcaccuggggaaacuugaauuggacuuugaucugugcgagggaaccacggugguagucgacgaacacugcggcaaucgagggcccucuuuaagaacuaccacagugaccggaaagaucauucaugagugguguugcagguccuguacucucccuccacugcgcuuccggggcgaggaugguugcugguacgggauggaaaucagacccgugaaagagaaggaagagaaccuugucaggaguaugguuagcgccggaucuggcgaaguggacuccuuuucacuggguauauugugugcuaguauuaugaucgaggagguaaugcgcagccgauggucgcggaagaugcucaugacaggcacccuggccguguuccuacugcucgucauggggcaacugacauggaaugaccuuauccguuugugcauuauggugggagcaaacgcuuccgauagaaugggcauggggacuaccuaucuggccuuaauggcaacguuuaaaaugaggccuauguucgccguuggacuccuguuucgccggcuuacaucuagagaagugcugcuacucaccaucggccugagcuuggucgcuucaguggagcugccaaacaguuuagaggaacucggugacgggcuggcgaugggaauuaugaugcuuaagcuguugacugaguuccagccccaccagcucuggaccacacugcuaucccugacuuuuauaaaaaccacgcuuucucucgauuacgccuggaagacaaccgcaauggcucugagcaucguuuccuuguucccgcuguguuuaucaacuacaagccagaaaaccacuuggcucccugugcugcuuggcaguuuuggcugcaagccacugacaauguucuugauuaccgagaauaagaucugggggaggaaaucuuggccccucaacgagggaauuauggccaucgguauagucuccauccugcuaagcucgcugcuuaagaaugacguaccucucgccggcccccugauugcugggggaauguugaucgcauguuaugugauuucaggcucuagugccgauuuaucccuggaaaaagcggcugagguuagcugggaacaagaggccgaacauucugguacgagccacaacauccucguggagguccaggacgaugggacuaugaagauaaaagacgaggaacgagaugacacccugacaauucuucugaaggcaaccuugcuagccguguccggaguauacccaaugucaaucccugcuacacuguuucucugguauuucuggcagaaaaagaagcagcgcaguggcgugcugugggauacucccagcccaccggaggucgaacgggcaguucuugacgauggcaucuacagaauuuuacaaagggggcugcucggacguucucaggugggugugggcgucuuccaggacgggguguuucauaccauguggcacguuacgcgcggagccguauugauguaucagggcaaacggcuggagccuuccugggcgucagugaagaaagaccucauaaguuacggugggggauggagauuccaaggcagcuggaauacaggcgaggaaguccaggugaucgcuguugagcccgggaagaaccccaagaaugugcagacuacccccggaacauuuaagaccccugaaggugaggucggcgccauugcacuggauuucaagccagggacuuccggaucucccaucgugaacagggaaggcaaaauuguaggucuuuacgggaauggagucgugaccacaucgggcacguauguuagcgccaucgcucaagccaaggcaucacaggagggcccucugccggagauagaagacgagguguuuaaaaagcgaaacuugacuaucauggaucuacacccaggguccggaaaaacccggcgcuaccugcccgcuauugucagagaagccaucaagaggaagcuccggacauuaauucuggcgccuacccgagugguugccagugagauggcagaagcucuuaaagguaugccaaucagauaucagacuacagccgugaagucugagcauaccggccgcgagauagucgaccugaugugccacgcuacguucacuaugaggcucuugagccccgugcguguaccuaauuacaacaugauuaucauggaugaagcacauuuuacagacccggccuccaucgccgcucggggguauauuucaaccagagugggaaugggcgaggcggcagccaucuucaugaccgcuacucccccagguucuguugaagccuuuccucagagcaaugcagucauacaagaugaggaaagggacauucccgagcgcaguuggaacuccggguacgauuggaucacagacuucccaggaaaaaccgugugguuugugccuagcauuaagucuggcaaugauaucgccaacugucugcggaaaaacggcaagagagucauacagcucucaagaaagacauucgacacugaguaucagaaaacgaagaauaacgacugggauuacguagugaccacagacauuuccgaaaugggggcuaauuucagggcggaucgcguuaucgacccccguagaugccugaaaccagugauccuuaaggauggaccggagcgggucauucuagccgguccuaugcccgugacuguugcaagugcugcccagaggcgcggccgaaucgggagaaaccaaaauaaagaaggagaccaguacguguauaugggccagccacugaacaaugaugaggaccacgcacauuggaccgaggccaagauguuguuagauaacauuaauacacccgaagguauaaucccugcucuguuugagccagaacgggaaaagagcgccgcgauugacggggaauacaggcuccgcggcgaggcaagaaaaaccuucgucgagcugaugaggcggggagaucuucccguguggcugucguauaagguagccucugaaggcuuucaguacuccgaccgucgcuggugcuucgauggggagcgaaacaaucaagugcucgaagagaacauggacguugaaaucuggacuaaagagggagagagaaagaaauugaggccucgguggcuggacgcucgcacguauagcgauccgcuagcccugagagaauuuaaggaguucgcugcagguaggcggucagucaguggcgaccucauccuugaaauugggaaacugccacagcacuuaaccucucgagcccagaaugcuuuggauaaccuggugaugcuccacaauuccgagcagggaggcaaggccuacagacaugcaauggaggaacugcccgacacaauagagacucuuaugcugcucgcguugaucgccgugcugaccgguggggucacauuauuuuuccuaagcggcaagggacugggcaaaaccucaauugggcuccuuuguguuacugcuaguagcgcccuguuguggauggcauccguggaaccucacuggaucgcugccucuauuauccuggaguuuuuccucaugguacugcuuauacccgaaccagaucgccaaaggacaccucaggacaaccagcucgcauauguggucaucggacuguuguuuaugauucugacgguggccgcuaacgagauggguuuacuagagaccacuaagaaagaucugggcaucgggcauguugcggccgaaaaucaccaacacgcaacaaugcucgacguggaucuucggcccgcuagcgccuggacccuguacgccgucgcaaccacaguaauuacuccaaugaugcgucauacgaucgagaacaccacagcuaauauauccuugacugccauugcgaaccaggcugccauccugaugggacucgacaagggcuggccuauuucaaaaauggauaucggugugccgcugcuugcauuagggugcuacucucagguuaauccccugacccucacagccgcuguguugaugcuggucgcacacuaugccauaaucggcccaggacuacaggcgaaggcuaccagagaagcccaaaagaggacugcagccggcauuaugaaaaacccuacgguggacgggaucgucgcuauugaucuggaccccgugguuuacgacgccaaguucgagaaacagcucggacagaucaugcuucugauauuguguacaagucagauucugcucaugcgcaccacuugggcacugugcgaaucgaucaccuuagcuacaggcccacuuacuacccugugggaggguagcccugggaaguuuuggaauacaacgaucgccguguccauggcgaacauuuuccggggaucuuaucucgccggcgcaggucuagcuuucucacugaugaaguccuugggcgggggacgaagaggcaccggggcccaaggagagacucugggcgaaaaguggaagaggcagcucaaucagcuuagcaaaagugaguuuaacacauacaagcgcucugguaucauggaaguagaucggagcgaggcaaaagaagggcugaagagaggagagaccacuaaacaugcugugucacguggcacagccaaguugaggugguucgucgagcggaaucugguuaagcccgaagguaaagugauagaccucggcugugggcgcggaggcugguccuauuacugcgccggguuaaagaaagucaccgaggugaagggauauacgaaaggcgguccggggcacgaggaaccaauuccuauggcgaccuacggauggaaccuggcuaaacuucauaguggcaaagauguauuuuucaugcccccagaaaagugugacacacugcuaugcgauaucggcgagagcucucccaauccuacuauugaggaagggcgaacccucagagugcugaagaugguugagccgugguugaggggaaaccaguuuuguaucaaaauacugaaucccuacaugccauccguggucgaaacacucgagcaaaugcagcggaagcacgguggcaugcuugugcgcaacccucugucaagaaauagcacucacgagauguauugggucucgugcgggaccggaaacaucgugucugcaguuaacaugacaaguaggauguuacugaaucgauucaccauggcccaucggaaacccacuuacgaacgugacguagauuugggcgcugguacgagacacguggccgucgagccugaaguggcaaaccucgacauuaucgggcagcgcauugagaauaucaagaacgaacauaaauccacauggcacuaugaugaggacaauccauacaagaccugggccuaucacggaagcuacgagguuaagucauccggcucugcuagcaguauggugaacggcgucgugaggcugcuaacuaaacccugggauguaauuccuauggugacccaaaucgcgaugacagacacgaccccauuugggcagcagcggguuuucaaggaaaaagucgacacuagaacaccccgcgccaagaggggaaccacucagauaauggaggugacagcaaaauggcuuugggguuuucugucccgaaauaagaagccgcggauuuguaccagagaagaguucacaaggaaagugcgcagcaacgcugccaucggcgcagucuuuguugaugaaaaucaauggaacucugccaaggaggcuguggaggacgaacguuucugggaucucguacaucgggagagagaacugcacaaacaggggaagugcgccacuugcguguauaauaugaugggaaaaagggagaagaaguugggcgaauuugguaaagcgaaggggucacgcgcaaucugguacauguggcugggagcccgauuccucgaguucgaggcucuuggcuuuaugaacgaagaccauugguucagucgggaaaauucccugagcggcgucgaaggggagggauuacacaaacuggguuacauuuugagagauauaucuaagaucccuggcgggaacauguaugccgacgauaccgcaggaugggacacgaggauuaccgaggaugaccuccagaaugaagcuaaaaucacagagauuauggaaccagagcaugcccugcuagcuacuucgaucuuuaaacuuaccuaccagaacaaagugguucgcgugcaaagacccgccaagaacggcacagucauggaugugauaucacggagggaccagcgugguagcgggcagguaggaacuuauggccugaauaccuucacgaacauggaaguucagcucauccgacaaauggaguccgagggcauuuuucugccuagugaauuggagacaccaaauuuagcagaacgcgugcuggauuggcucgagaagcacggggcggaaagacuuaaacggauggccaucucuggagacgacugugucgugaagcccauugaugacagguucgcuaccgcccugacugcacuaaacgauauggguaaagugcgcaaggacaucccgcagugggagccuagcaaaggcuggaaugauuggcagcagguccccuuuugcucccaccauuuccaccaacugauaaugaaggacgggagagagauuguugugccaugucggaaccaggaugaacucguaggaagggcucgagugucacagggcgccgguuggaguuugcgugagacagcaugccuggggaagucuuacgcccaaauguggcagcuuauguauuuucauagacgcgaccugcggcucgcggcuaaugccaucuguagcgcagucccuguggauuggguucccaccuccaggacuaccuggucaauccacgcccaccaucaguggaugacaacggaagacauguuaagcguguggaacagagucuggauugaggaaaauccauggauggaggauaaaacccacgugucuuccugggaggaaguacccuaccugggaaagcgcgaggaccaguggugcggcaguuugauaggccugacugcucgggccacaugggcaaccaacauccaaguugcuauuaaucaggugaggcgacucaucgggaacgaaaauuaucuugacuacaugacuagcaugaaaagauucaagaacgagucggauccugagggagcccugugguga

SEQ ID NO: 13365 - RNA, 9879 nt, Artificial Sequence
  derived and/or modified CDS sequence (opt3) from DENV-1__GQ868534__SS-prME
agcgugaccaugcugcucaugcuucugcccacagcauuggcuuuccacuuaacuacgagaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuacaggauucuucaacgaggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaagaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaucgggcacguaugucagcgcaaucgcccaagcuaaggccucacaggaagggccucuuccggagauagaggacgaaguguuuaaaaagcgaaaccugacuaucauggauuugcacccaggauccgguaaaacccggcgcuaccuacccgcaauuguuagagaggcuaucaagaggaagcugcggacacucauuuuagccccuacccgaguggucgcgagugaaauggccgaggcacugaaaggcaugccaaucagauaucagacuacagcugugaagucugaacauaccgggcgcgagauaguagaccuuaugugccacgccacguucacuaugaggcugcucagccccgugcguguuccuaauuacaacaugauuaucauggaugaggcucauuuuacagacccggcauccaucgccgcccggggauauauuucaaccagagucggcaugggugaagcugcggcaaucuucaugaccgccacucccccagggucuguggaggcuuuuccucagagcaaugccgugauacaagaugaagagagggacauucccgaacgcaguuggaacuccggauacgauuggaucacagacuucccaggcaaaaccgucugguuuguaccuagcauuaagucuggcaaugauaucgcaaacuguuugagaaagaacgggaagagagugauacagcugucacggaagacauucgacacugaguaucagaaaacgaagaauaacgacugggauuacguugugaccacagacauuuccgagaugggagccaauuucagggcugaucgcgucaucgacccccguagaugccucaaaccagugauccugaaggaugguccggaacggguuauucuugcgggcccuaugcccgugacugucgccagugcagcucagaggcgcgggcgaaucggaagaaaccaaaauaaagagggcgaccaguacguguauaugggucagccacuaaacaaugaugaagaccacgcccauuggaccgaggcaaagaugcuguuggauaacauuaauacacccgaggggauaaucccugccuuauuugaaccagagcgggaaaagaacgcugccauugacggcgaguacaggcugcgcggagaagcgagaaaaaccuucguagagcucaugaggcggggcgaucugcccguguggcuuagcuauaagguugcaucggagggguuucaguacucugaccgucgcuggugcuucgauggagaacgaaauaaccaaguccuggaggaaaauauggacguggagaucuggacuaaagaaggugagagaaagaaacucaggccucggugguuggacgcccgcacguauuccgauccgcuggcucuaagagaguuuaaggaguucgccgcuggcaggcggagcgugucaggggaccugauccucgagauuggaaaacuuccacagcaccugaccuuacgagcacagaacgccuuggauaaucuggucaugcuccacaacagugaacagggcgguaaggcuuacagacaugccauggaggaacugcccgacacaauagagacucuuaugcugcucgcauugaucgcgguucugaccgggggcgugacauuauuuuuccuaucuggaaagggccuggggaaaaccuccauuggacuccuuuguguaacugccagcucagcucuguuguggauggccaguguggagccucacuggaucgcagcuagcauuauccuggaauuuuuccucaugguccugcuuauacccgagccagaucgccaaaggacaccucaggacaaccagcucgccuaugugguuaucggucuguuguuuaugauucugacgguggcagccaaugaaaugggcuuacuagagaccacuaagaaagaucuggggaucggacaugucgcugcggagaaccaccaacacgccacaaugcucgacguagaucuucggcccgcauccgcuuggacccuguacgccguggccaccacaguuauuacuccaaugaugcgucauacgaucgaaaauaccacagcaaacauaucuuugacugcuauugccaaucaggcggcuauccugaugggccucgacaaggguuggccuauuagcaaaauggauaucggggugccgcugcuugccuuaggcugcuacucccaggucaacccccugacccucacagcagccguguugaugcuggucgcucacuaugcaauaaucggaccaggccuacaggccaaggcgaccagagaggcucaaaagaggacugccgcagggauuaugaaaaauccuacgguggacggaaucguugccauugaucuggaccccgugguauacgacgcuaaguucgaaaaacagcucggccagaucaugcuucugauauuguguacaucacagauucugcucaugcgcaccacuugggcccugugcgagucuaucaccuuagcaacagguccacuuacuacccugugggaagggaguccuggaaaguuuuggaacacaacgaucgcugugucgauggccaauauuuuccggggcagcuaucucgcgggugccggccuagcauucucccugaugaaaucucuagggggaggccgaagagggaccggagcucaaggcgagacucugggugagaaguggaagaggcagcucaaccagcuuucaaaaagcgaauuuaauacauacaagcgcuccgggaucauggaggucgaucggagugaagccaaagagggacugaagagaggcgaaaccacuaaacaugcaguuucucgugguacagcuaaguugaggugguucguggagcggaaccuggucaagcccgagggcaaagugauagaccucggguguggacgcggcggguggagcuauuacugcgccggauuaaagaaaguaaccgaagugaagggcuauacgaaaggugggccgggacacgaggaaccaauuccuauggccaccuacggcuggaaucugguuaaacuucauucaggcaaagauguguuuuucaucccaccagagaagugugacacacugcuaugcgauauuggggaauccagucccaacccuacuaucgaggagggacgaacccucagaguccugaagaugguggaaccgugguugagggguaaucaguuuuguauaaaaauccugaaccccuacaugccaagcgucguggaggcgcucgaacaaaugcagcggaagcacggcgggaugcuuguucgcaauccucugucuagaaacuccacacacgagauguauuggguaucaugcggaacuggcaacauugugagcgcugucaauaugaccucgaggauguuacugaaccgauucacaauggcacaucggaaacccaccuacgagcgugacguggauuugggugccgggacuagacacguugcuguggaaccugaggucgccaaucucgacaucauuggacagcgcaucgaaaacauuaagaaugagcauaaaucuacguggcacuaugaugaagacaacccauacaagacaugggcauaucacggcaguuacgaggugaagcccuccggcagcgccucauccaugguaaauggggugguuaggcugcuaaccaaaccuugggaugucaucccaauggugacucaaauagcuaugaccgacacaacgcccuuuggacagcagcggguguucaaggagaaagucgacaccagaacuccgcgcgcgaagagggguacaacccagauuauggaaguuacugccaaauggcuuuggggcuuucugucucgaaacaagaagccucggaucuguacaagagaggaguucaccaggaaagugcgcagcaaugcagcuaucggggccguauuuguggaugagaaccaauggaauagugcaaaggaagccgucgaggacgagcguuucugggaucucgugcaucgggaaagagagcugcacaaacagggaaagugcgcuacaugcguuuauaacaugaugggcaaaagggaaaagaaguugggugaguuugggaaagccaagggaucccgcgcgauuugguacauguggcugggcgcacgauuccucgaguucgaggcccuuggcuuuaugaaugaggaccauugguucagccgggaaaacucucugucagggguggagggagaagguuuacacaaacugggcuacauauugagagauaucaguaagauuccagggggaaauauguaugcugacgauacugccggcugggacaccaggaucacggaggaugaccuccagaacgaggcaaaaauuaccgaaaucauggagcccgaacaugcucugcuagccacauccauauuuaaacuuacuuaccagaacaaagucgugcgcguacaaagaccugcuaagaaugguaccguuauggaugugaucagccggagggaccagcgugggucuggacaggucggcacauauggccugaacacuuucaccaauauggaggugcagcucauucgacaaauggaaucggaggggaucuuucugccaucagaguuggaaacgcccaacuuagccgagcgcgcacuggauuggcucgaaaagcacggagcggagagacuuaaacggauggccauuagcggugacgacuguguggucaagccgaucgaugacagguucgcuacagcccugaccgcacuaaaugauaugggcaaaguucgcaaggacauaccucagugggaacccuccaaaggguggaacgauuggcaacaggugccauuuugcagucaccauuuccaccaacugauuaugaaggacggaagagagaucguagugccuugucggaaucaggaugagcucgucggcagggcucgagugucucagggugccggguggagcuugcgugaaacugcaugccugggaaaguccuacgcccaaauguggcagcuuauguauuuucauagacgcgaccugcggcucgcggcuaacgccaucuguucagcaguucccguggauugggucccaacaaguaggaccacuuggucuauucacgcccaccaucaguggaugaccacagaggacauguuaagcguguggaauagaguauggauagaagagaaccccuggauggaagauaaaacgcacguuuccucaugggaggaggugccuuaccugggcaagcgcgaagaccaguggugcggcagcuugaucgggcugaccgcucgggccacuugggcaacaaauauucaagucgcuaucaaccaggugaggcgacucauuggaaaugagaacuaucuugacuacaugaccucuaugaaaagauucaagaaugaauccgauccagagggugcccugugguga

SEQ ID NO: 13366 - RNA, 9879 nt, Artificial Sequence
  derived and/or modified CDS sequence (opt3) from DENV-1__GQ868535__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagagguggccaacccugcuauucuuagaaaacugugcaucgaagccaagauauccaauaccacgaccgacucuagguguccaacacagggagaggcaacuuugguggaagagcaggaugcuaacuucgucugccggcgcaccuuuguugaccgaggcugggguaauggguguggacucuucggcaaaggcagccuguuaacaugcgccaaguuuaagugcgugacuaaacuggaggggaagauuguacaguacgaaaaccucaaauauuccgugaucgucaccgugcacacaggagaucaacaucagguugguaaugagaccacugaacacggcacgauugcgacaaucaccccccaggccccuacuucagagauccagcuuaccgacuacggggcacugacauuggacuguaguccaagaaccggacuagauuucaacgaaauggugcugcucacuaugaaggagaaaagcuggcugguccauaagcaaugguuucuugaccugccguugcccuggacaucuggcgcuuccacgucacaggagaccuggaauaggcaggaucuccuggugacuuucaaaacagcccacgcuaagaagcaagaaguaguuguguuagguagccaggagggggccaugcacaccgcacugacaggcgccacugaaauucagaccaguggaacgaccacaauauuugcuggccaucuaaaaugccggcucaagauggacaaacugacucuuaaggggaccucuuaugucauguguacaggauccuucaaauuggagaaggaaguggcggagacucagcacgguaccguccuggugcaaguuaaguacgagggcacggaugcaccuugcaaaaucccauucagcacacaggacgaaaagggggugacccagaacggacgucucauuacugccaaucccaucguaacagauaaagagaagccugucaacauagaaaccgagccacccuuuggcgagucguauauugugguuggugcuggggaaaaagcccugaagcuuucuugguucaagaaaggcuccucaaucggaaagauguuugaggcaacugcccgcggcgcuagaaggauggccauccugggggacaccgcaugggauuucggaaguauugguggcguguuuacaagcgucgggaaauuggugcaucagguauucggaacggcguacggcgugcucuuuuccgguguuucuuggaccaugaagaucgggauuggcauacuguuaacuuggcugggacuaaauagccggucaacaagucucuccaugaccuguaucgcugucggcauggugacacuguaccuuggggugaugguccaagccgacagcggaugcguuauuaacuggaaaggccgagaauugaagugugguucugggaucuucgugacuaacgaggugcacaccuggacggaacaguauaaguuucaggcagauucaccgaaacgccugagugccgcuaucggaaaggccugggaggagggcguaugcgguauuagaagcgcaacaaggcucgaaaauauaauguggaaacagaucuccaacgagcugaaucauauuuuacuggaaaacgacaugaaguucaccgucgugguuggcgacgcuaaugggauccuugcccaaggaaaaaagaugauucggccucagcccauggagcacaaauacucuuggaagucguggggcaaggcgaaaaucauaggggccgauauccagaacacuaccuuuauuaucgacggaccagauacaccugaaugucccgacaaucagcgcgcuuggaacauuugggagguggaggauuauggcuucgguaucuuuacuaccaauauaugguugaagcucagagacagcuacacacaaaugugcgaucacaggcugauguccgcagccauuaaagacucaaaggcuguccaugccgauaugggguauuggaucgaaagugagaaaaacgaaacguggaagcuagcacgugcgucuuucauugaggugaagaccuguacuuggccaaaaagccacacacugugguccaauggaguucucgaaucagagaugaucauacccaagaucuacggcgguccuauuagccagcauaacuaucggccaggcuacuucacccagacugccgggccguggcaccugggaaaacuugaguuggacuuugaucugugcgaaggcacaaccgugguagucgacgagcacugcgggaaucgaggacccucuuuaagaacgacuaccgugacaggcaagaucauucaugaaugguguugcagguccuguacccucccuccacugcgcuuccggggugaggaugggugcugguacggaauggagaucagacccgugaaagaaaaggaggaaaaccuugucaggaguaugguuagcgcuggcucuggugagguggacuccuuuucacugggcauauugugugccaguauuaugaucgaagagguaaugcgcagccgauggucgcggaagaugcucaugacugggacacuggcaguguuccuacugcucaucaugggacaacugaccuggaaugaccuuauucguuugugcaucauggucggcgcuaacgccuccgauagaauggggaugggaacaacuuaucuggcauuaauggccaccuuuaaaaugaggccuauguucgcugugggccuccuguuucgccggcuuacgucuagagagguucugcuacucacaauuggucugagcuugguggcgucagucgaacugccaaacaguuuagaggaacucggggacggacuggccaugggcauaaugaugcuuaagcuguugaccgaguuccagccccaccagcucuggacuacccugcuaucccugacauuuaucaaaacuacccuuucucucgauuacgcauggaagacgacagcuauggcccugagcauuguguccuuguucccgcuguguuuaucaaccacuagccagaaaacaaccuggcucccuguucugcuuggcaguuuugggugcaagccacugacuauguucuugaucacagaaaauaagauuuggggaaggaaaucuuggccccucaacgaggguaucauggccauaggcaucguguccauucugcuaagcucgcugcuuaagaaugacgucccucucgcugggccccugaucgcaggaggcauguugauugccuguuauguaaucucagguucuagugcggauuuaucccuggagaaagcugccgaagugagcugggagcaagaagcagagcauucugggaccagccacaacauacucguugaagugcaggacgauggaacgaugaagauuaaagacgaggagcgagaugacacucugaccauccuucugaaggccacauugcuagcugucuccggcguguacccaaugucaaucccugcaacccuguuuguaugguauuucuggcagaaaaagaagcagcgcaguggcgugcucugggauacacccagcccaccggaagucgagcgggccguucuggacgaugggauuuacagaauacuucaaaggggauuacugggucguucucaggugggcgugggggucuuccaggacggaguguuucauacuauguggcacguuacccgcggcgcgguacucauguaucaggguaaacgguuggaaccuuccugggcuucagugaagaaagaccugaucaguuacgggggaggcuggagauuccaaggcagcuggaauaugggggaggagguccaggugauugccguugaacccggaaagaacccaaaaaaugugcagacgacacccgguacuuuuaagaccccugagggcgaagucggggcaaucgcccucgauuucaagccaggaacauccggcucucccauugugaacagggaggguaaaaucguagggcuguacggaaauggcgucgugaccacuucgggcaccuauguuagcgcuauagcccaagcaaaggcuucacaggaagggccucuuccggagaucgaggacgaaguguuuaaaaagcgaaaccugacaauuauggauuugcacccaggauccgguaaaacgcggcgcuaccuacccgccaucgucagagaggcgauuaagaggaagcugcggacucucaucuuagccccuacccgagugguugcaagugaaauggcugaggcccugaaaggcaugccaauaagauaucagacaaccgcugugaagucugaacauacugggcgcgagauugucgaccuuaugugccacgcaacauucaccaugaggcugcucagccccgugcguguaccuaauuacaacaugaucaucauggaugaggcccauuuuacggacccggccuccauugcugcgcggggauauaucucaacuagagugggcaugggugaagcagccgcuauauucaugacagccacccccccagggucuguugaggcauuuccucagagcaaugccgucauucaagaugaagagagggacauccccgaacgcaguuggaacuccggauacgauuggauuaccgacuucccaggcaaaacugugugguuugugccuagcaucaagucuggcaaugauauagcuaacuguuugcgaaaaaacgggaagagagucauucagcugucacggaagacauucgacaccgaguaucagaaaacaaagaauaacgacugggauuacguagugacuacggacaucuccgagaugggagcgaauuucagggccgaucgcguuaucgacccccguagaugccucaaaccagugauucugaaggaugguccggaacgggucauccuugcaggcccuaugcccgugaccguugcuagugccgcacagaggcgcgggcgaauuggaagaaaccaaaauaaagagggcgaccaguacguguauaugggucagccacuaaacaaugaugaagaccacgcccauuggacagaggcuaagaugcuguuggauaacauaaauacucccgaggggaucauuccugccuuauuugaaccagagcgggaaaagagcgcggcaaucgacggcgaguacaggcugcgcggagaagccagaaaaaccuucgucgagcucaugaggcggggcgaucugcccguguggcuuucguauaagguagcuucugagggguuucaguacuccgaccgucgcuggugcuucgauggagaacgaaacaaucaagugcuggaggaaaacauggacguugagaucuggacaaaagaaggugagagaaagaaacucaggccucggugguuggacgcccgcaccuauagcgauccgcuggcucuaagagaguuuaaggaauucgcagccggcaggcggucagucaguggggaccugauucucgagauaggaaaacuuccacagcaccugacuuuacgagcucagaaugccuuggauaaccuggugaugcuccacaauucugaacagggcgguaaggcauacagacaugcgauggaggaacugcccgacacgaucgagacccuuaugcugcucgccuugauugcugugcugacagggggcgucacuuuauuuuuccuauccggaaagggccuggggaaaaccagcaucggacuccuuuguguuacagccucaagugcacuguuguggauggcuagcguggagccucacuggauugccgcauccaucauacuggaauuuuuccucaugguacugcuuauccccgagccagaucgccaaaggaccccucaggacaaccagcucgccuauguggucauuggucuguuguuuaugauccugacuguggcugcgaacgaaaugggcuuacuagagacaacgaagaaagaucuggggauuggacauguugccgcagagaaucaccaacacgcuaccaugcucgacguggaucuucggcccgccucugccuggacucuguacgcagucgcuacaaccguaaucaccccaaugaugcgucauacaauagaaaacacuacggccaauauuagcuugaccgcgaucgcuaaccaggccgcaauucugaugggccucgacaaggguuggccuaucuccaaaauggauauaggggugccgcugcuugccuuaggcugcuacucacagguuaauccccugacacucacugcugcaguguugaugcuggucgcccacuaugcgaucauuggaccaggccuacaggcuaaggccaccagagaggcacaaaagaggacagccgcugggaucaugaaaaacccuaccguggacggaauugucgccaucgaucuggaccccgugguuuacgacgcaaaguucgaaaaacagcucggccagauaaugcuucugauuuuguguacuucucagauccugcucaugcgcacgacaugggcucugugcgagaguaucaccuuagccacugguccacuuaccacacugugggaagggucgccuggaaaguuuuggaauacuaccauugcggugagcauggccaacaucuuccggggcuccuaucucgcaggugcuggccuagccuucucucugaugaaaucauuggggggaggccgaagagggacaggagcacaaggcgagacgcugggugagaaguggaagaggcagcucaaucagcuuagcaaauccgaauuuaacaccuacaagcgcagugggauaauggagguagaucggucugaagcuaaagagggacugaagagaggcgaaacuacaaaacaugccgugagccgugguaccgccaaguugaggugguucgucgagcggaaucugguuaagcccgagggcaaagugauugaccucggguguggacgcggcggguggucauauuacugcgcgggauuaaagaaagucacugaagugaagggcuauacaaaaggugggccgggacacgaggaaccaaucccuauggcuaccuacggcuggaaccugguaaagcuucauuccggcaaagauguguuuuucaugcccccagagaagugugacacgcugcuaugcgauauuggggaaaguagccccaauccuaccaucgaggagggacgaacacucagaguucugaagaugguggaaccgugguugagggguaaccaguuuuguauaaaaauccugaaucccuacaugccaucugucguggagacucucgaacaaaugcagcggaagcacggcgggaugcuuguccgcaacccucuguccagaaauucaacccacgagauguauugggugagcugcggaacaggcaacauuguuucggcaguaaacaugacuucuaggauguuacugaaucgauucaccauggcccaucggaaacccacauuugagcgugacguggauuugggugcugggaccagacacgucgccguggaaccugagguugcaaaccucgacaucauuggacagcgcaucgaaaauauuaagaacgagcauaaaaguacuuggcacuacgaugaagacaauccauauaagacgugggccuaccacggcuccuaugaggugaagcccagcggcucagcuuccucuauggucaacggggugguaaggcugcuaacaaaaccuugggaugugaucccaaugguuacccaaauagcgaugacugacaccacacccuucggacagcagcgggucuuuaaggagaaaguggacacgagaaccccgcgcgccaagagggguacuacacagauuauggaagugaccgcaaaauggcuuuggggcuuccugagccgaaauaagaagccucggaucuguacuagagaggaauuuacaaggaaaguccgcaguaacgcugccaucggggcaguuuucguggaugagaaucaauggaacuccgccaaggaagcuguagaggacgagcguuuuugggaucucgugcaucgggaaagagagcugcacaaacagggaaagugcgccaccugcgucuacaauaugaugggcaaaagggaaaagaaguugggugaguucgggaaagcgaagggaagccgcgcaauuugguauauguggcugggcgcccgauuccucgaauuugaggcucuuggcuucaugaacgaggaccauugguuuucucgggaaaauucacugagugggguggagggagaagguuuacacaaacugggcuacauauugagagauaucuccaagauuccagggggaaacauguacgccgacgauacagcaggcugggacacuaggaucaccgaggaugaccuccagaaugaggcuaaaauuacggauaucauggaacccgagcaugcccugcuagcuaccagcauauucaagcuuacauaucagaacaaaguugugcgcguccaaagaccugccaagaacgguacugugauggacguaaucucucggagggaucagcgugggucgggacagguuggcaccuacggccugaauacauuuacuaacauggaagugcagcucauucgacaaauggagucagaagggaucuuccugccaagcgaguuggagacccccaauuuagcagaacgcguccuggacuggcucgagaagcacggagcggaaagacuuaaacggauggccauuuccggugacgauuguguggugaagccgaucgacgauagguuugcuacggcccugacagcacuaaacgacaugggcaaaguccgcaaggauauaccucagugggagcccaguaaaggguggaaugacuggcagcagguuccauucugcucucaccauuuucaccaacugauuaugaaggauggaagagaaaucgugguaccuugucggaaccaggacgagcucgugggcagggcucgagucagccagggugccgggugguccuugcgugagaccgcaugccugggaaagucauaugcccaaauguggcagcuuauguacuuccauagacgcgaucugcggcucgcggcuaaugccaucuguagugcagugcccguugacugggugccaacuucuaggacaaccuggagcauucacgcccaccaucaguggaugacuaccgaagauauguuauccgucuggaacagaguguggauagaggaaaaucccuggauggaggacaaaacacacguaucaagcugggaagagguuccuuaucugggcaagcgcgaggaccaguggugcggcucuuugaucgggcugacggcucgggccaccugggcaacuaacauucaaguggcuaucaaucaggucaggcgacucauuggaaacgaaaauuaccuugauuauaugacauccaugaaaagauuuaagaacgagagugacccagaaggugcccugugguga

SEQ ID NO: 13367 - RNA, 9879 nt, Artificial Sequence
  derived and/or modified CDS sequence (opt3) from DENV-1__KJ189306__SS-prME
agcgugaccaugcugcucaugcuucugcccacugccuuggcuuuccacuuaacuacgagaggaggggaaccucauaugaucgucuccaagcaggaaaggggaaaaucucugcuguuuaagaccucagccgguguuaacaugugcacacucauugccauggaccugggagaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauuuucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggaccuuucaaauuggagaaggaaguggcugagacccagcacgguacgguccuggugcaaguuaaguacgagggcacagaugcgccaugcaaaauccccuuccucacccaggacgaaaagggggugacucagaacggacgucugauuacagcaaauccuaucguaaccgauaaagagaagccagucaacauagaaacugagcccccguuuggcgaguccuauauugugguuggugccggggaaaaagcucuuaagcugagcugguucaagaaaggcucgucuaucggaaagauguuugaggccaccgcacgcggcgccagaaggauggcuaucuugggggacacagccugggauuucggauccauugguggcguguuuacgucagucgggaaacucgugcaucagguauucggaaccgcauacggcgugcuguuuagugguguuagcuggacuaugaagaucgggauuggcauauuacugacauggcuaggacucaauucccggucuaccagccugucaaugacauguaucgcggucggcauggugacucuuuacuugggggugaugguccaagcugacaguggaugcguuauuaacuggaaaggccgagaacugaagugugguuccgggaucuucgugaccaacgaggugcacacguggacagaacaguauaaguuucaggccgauagcccuaaacgccucucugcagccaucggaaaggcuugggaggagggcguaugcgguauuagaucagccaccaggcuggaaaauauaauguggaaacagaucaguaacgaguuaaaucauauucugcuugaaaacgacaugaaguucacugucgugguuggcgacgcaaaugggaucuuggcucaaggcaagaaaaugauucggccccagccaauggagcacaaauacagcuggaaauccuggggcaaggccaaaaucauaggggcggauauccagaacaccacauuuauuaucgacggaccugauacucccgaauguccagacaaucagcgcgccuggaacauuugggagguggaggauuauggcuucgguaucuuuaccacaaauauauggcucaagcugagagacucuuacacgcaaaugugcgaucacaggcuaaugucggcugcaauuaaagacagcaaggccguccaugcugauaugggguauuggaucgaauccgagaaaaacgaaaccuggaagcuggcccgugcaucauucauugaggugaagacuuguacauggcccaaaagucacacccucuggucuaauggaguucuggaaagcgagaugaucauaccuaagaucuacggcgguccaauuucccagcauaacuaucggccgggcuacuucacucagacagcggggcccuggcaccuuggaaaauuggagcuggacuuugauuuaugcgaaggcaccacggugguagucgacgagcacugcgggaaucgaggaccuucacucagaacuaccacagugaccggcaagaucauucaugaaugguguugcaggagcuguacucugccaccccuucgcuuccggggugaggaugggugcugguacggaauggagaucagaccugugaaagaaaaggaggaaaaccuggucaggucuaugguuuccgccggcaguggugagguggacagcuuuucuuugggcauacucuguguauccauuaugaucgaagaggugaugcgcucacgauggagucggaagaugcugaugacagggacccuagcugucuuccugcuccuggugaugggacaacuuacauggaaugacuugauccgucugugcauuaugguuggcgccaacgcaagcgauagaauggggaugggaacuaccuauuuagcucucauggccacguuuaaaaugaggccaauguucgcagugggccugcuuuuucgccggcugacaucgagagagguccuacuccugaccaucgguuugucccugguggccucuguugaauuacccaacagccucgaggaacugggggacggacuugcuaugggcauuaugaugcugaaguugcucacugaguuccagccgcaccagcuguggaccacacuacugucacuuacuuuuauaaaaaccacgcucagucuggauuacgcguggaagacaaccgccauggcauuguccaucgugucucuguucccuuuaugucucagcacuacaucccagaaaaccacuuggcugccaguccuucugggcucauuugggugcaagcccuugacaauguuccucauuaccgaaaauaagaucuggggaaggaaaagcuggccucugaacgaggguauuauggcuaucggcauaguaaguauccuacugucuucccuucucaagaaugacgugccccuggccgggccauugauugccggaggcauguuaaucgcuuguuauguuauuagcgguucgucagcagaucugucucucgagcgagccgcggaagugaguugggagcaagaagcugagcauuccgggacgagccacaacauccuggucgaagugcaggacgauggaacuaugaaaauaaaggacgaggagcgcgaugacacccuuacaauucuguugaaagccacccuacuggcaguaucuggcguguacccuaugagcauccccgccacacucuuugucugguauuucuggcagaagaaaaagcagcgguccggcguucugugggauacuccaucaccgccugaaguggagagagcugugcuugacgaugggaucuacaggauuuuacaacguggacugcucggucgcagucaggucggcguggggguuuuccaggacggaguauuucauaccauguggcacgugacgcggggcgcagucuugauguaucaggguaagagacuggaacccagcugggccucugugaaaaaggaccucauauccuacgggggaggcuggagguuccaaggcucauggaauacaggggaggagguucaggugaucgcggucgaaccaggcaaaaaccccaagaaugugcagacuaccccugguacauuuaaaaccccagagggcgaaguaggggcuauugcccuggauuucaagcccggaacaaguggcagcccuaucgucaaccgagaggguaagauuguggggcuuuacggaaauggcguugugaccacauccggcacguaugucucugcaaucgcccaagcuaaagccucgcaggaagggccgcugccagagauagaggacgaaguguuuaagaaacggaacuugacuaucauggaucuacaccccggaagcgguaagacccgcagauaccugccugcaauuguuagggaggcuaucaaacggaagcuccgaacauuaauucuggccccaaccagaguggucgcgucagaaauggccgaggcacuuaagggcaugcccauccgcuaucagacuacagcugugaaauccgaacauaccgggagggagauaguagaccugaugugccacgccacguucacuaugcgucucuugaguccugugcggguuccgaauuacaacaugauuaucauggaugaggcucauuuuacagaccccgcaucuaucgccgccagaggauauauuagcaccagggucggcaugggugaagcugcggcaaucuucaugaccgccacuccaccuggguccguggaggcuuuuccccagucaaaugccgugauacaagaugaagaacgcgacauuccagaacgaucuuggaacagcggauacgauuggaucacagacuucccuggcaagaccgucugguuuguacccaguauuaaauccggcaaugauaucgcaaacugucugagaaagaacgggaaacgggugauacagcucagcaggaagacauucgacacugaguaucagaagacgaaaaauaacgacugggauuacguugugaccacagacauuucugagaugggagccaauuuccgcgcugaucgugucaucgacccaagacggugccugaagccggugauccuuaaagaugguccugaaaggguuauucuagcgggccccaugccagugacugucgccucagcagcucagcgccgagggagaaucggacggaaccaaaauaaggagggcgaccaguacguguauaugggucagccccugaacaaugaugaagaccacgcccauuggaccgaggcaaaaauguuguuagauaacauuaauacaccugaggggauaaucccagcccuguuugaacccgagagggaaaaguccgcugccauugacggcgaguaccgccucagaggagaagcgaggaagaccuucguagagcugaugcggcguggcgaucuuccuguguggcugaguuauaaaguugcaagcgagggguuucaguacucggaccgccgauggugcuucgauggagaaagaaacaaucaaguccucgaggaaaacauggacguggagaucuggacuaaggaaggugagaggaaaaaguugcggccgcgcuggcuggacgccagaacguauucugauccacuagcucugagggaguuuaaagaguucgccgcuggccggcgauccgugagcggggaccucauccuugagauuggaaagcugccccagcacuuaaccuugagagcacagaaugcccuggauaaccucgucaugcugcacaauucagaacagggcgguaaggcuuaccgccaugccauggaggaacuuccugacacaauagagacucugaugcucuuggcacugaucgcgguuuuaaccgggggcgugacacuauuuuuccugaguggaaagggccucgggaagaccucuauuggacuucuguguguaacugccuccagcgcuuugcuguggauggccucaguggagccccacuggaucgcagcuaguauuauccucgaauuuuuccugaugguccuucucauaccagagccugauaggcaacggacaccccaggacaaccagcuggccuaugugguuaucgguuugcuguuuaugauuuuaacgguggcagccaacgaaaugggccuacuggagaccacuaaaaaggaucucgggaucggacaugucgcugcggagaaucaccaacacgccacaaugcuugacguagaucugcguccagcaagcgcuuggaccuuguacgccguggccaccacaguuauuacuccuaugaugagacauacgaucgaaaacaccacagcaaauauaucccugacugcuauugccaaccaggcggcuauccucaugggccuggacaaagguuggccgauuucuaagauggauaucggggugccccuuuuagcccugggcugcuacagccaggucaauccacucaccuugacagcagccgugcugaugcuagucgcucacuaugcaauaaucggaccuggccugcaggccaaagcgaccagggaggcucaaaagcgcacugccgcagggauuaugaagaaccccacgguggacggaaucguugccauugaucucgacccagugguauacgacgcuaaauucgaaaagcagcuuggccagaucaugcuguugauacuguguacaucccagauucuccugaugcggaccacuugggccuuaugcgagucaaucacccuugcaacagguccucugacuacccucugggaagggucucccggaaaauuuuggaauacaacgaucgcugugaguauggccaacauuuuccgaggcucguaucuagcgggugccggccuggcauucagcuugaugaagucccuagggggaggcagaagggggaccggagcucaaggcgagacucucggugagaaauggaagcgccagcuuaaucagcugucuaagucagaauuucauaucuacaaacggagcgggauaauggaggucgauagauccgaagccaaggagggauugaaacguggcgaaacaaccaagcacgcaguuaguagggguacugcuaaacugcggugguucguggagcgcaaccucgucaagccggagggcaaggugauugacuuaggguguggacgaggcggguggucuuauuacugcgccggacugaaaaagguaacagaagugaaaggcuauaccaagggugggccaggacaugaggaaccuauccccauggccacguacggcuggaaucuuguuaaacugcacagcggcaaggauguguuuuucaugccacccgagaaaugugacacccuacucugcgauauuggggaaucauccccuaacccgacaaucgaggagggaagaacucugagggucuugaagaugguggaacccuggcugcgggguaaucaguuuuguauaaagauccucaacccauacaugccuagugucguggagacccuugaacaaaugcagcgcaaacacggcgggaugcugguuagaaaucccuuaagcaggaacucuacacaugagauguauuggguauccugcggaacuggcaauauugugucagcggucaacaugaccagccgaaugcuguugaaccgguucacaauggcucaccguaagccuaccuacgagagagacguggaucucggugcagggacucgccauguugccguggaaccagaggucgcuaaucuggacaucauuggacagaggaucgaaaacauuaaaaaugagcacaagucgacguggcacuaugaugaagacaaccccuacaaaacaugggccuaucauggcucuuacgaggugaagccuaguggcuccgcaagcucaaugguaaauggggugguucggcuacuuaccaagccaugggaugucauccccauggugacucaaauagccaugaccgacacaacgccguuuggacagcagagaguguucaaagagaaggucgacacccgcacuccuagggcuaaacgagguacaacccagauuauggaaguuacugcgaaguggcuguggggcuuucucucccggaacaaaaagccaagaaucuguacaagggaggaguucauccgcaaggugcguucuaaugccgcaauuggggcuguauuuguggaugagaaccaauggaauagcgccaaagaagcagucgaggacgagcgguucugggaucuggugcacagagaaagggaguugcauaagcagggaaaaugcgcaaccugcguuuauaacaugaugggcaagcgcgagaaaaagcugggugaguuugggaaggcuaaaggaagucgagccauaugguacauguggcucggcgcgcgguuccuugaguucgaggcacugggcuuuaugaaugaggaccacugguucuccagagaaaacagcuuaucugggguggagggagaaggucugcauaaguugggcuacauccucagggauauuucaaaaauccccgggggaaauauguaugccgacgauacagcuggcugggacacucgcauuaccgaggaugaccugcagaacgaggccaagaucacggaaauaauggagccugaacacgcacuacuugcuaccaguaucuuuaaacugacauaccagaauaaggucgugagaguacaacggccagccaaaaacgguacuguuauggaugugauuuccaggcgugaccagcgagggagcggacaggucggcaccuauggccucaacacauucacuaauauggaggugcagcugauccgccaaauggaaucugaggggauauuuuugcccucggaguuagaaaccccgaaccuggcugagagagugcucgauuggcuugaaaagcacggagccgagcggcugaagaggauggcaaucucaggugacgacugugucguuaaaccuauagaugaccgcuucgcgacggcccuaacagcucugaaugauaugggcaaggugagaaaagacauuccccagugggaaccaagcaagggguggaacgauuggcagcagguaccuuuuugcucccaucacuuccaucaacucaucaugaaagacggacgggagaucgugguccccuguaggaaucaggaugaguuggugggccgagcccguguuagucagggugcaggguggucucugagagaaaccgcuugccuuggaaagagcuacgcccaaauguggcagcugauguauuuucaccgccgggaccucagguuagcagccaacgcgauuuguuccgcugugccagucgauugggugcccacuucaagaacaaccuggaguauacacgcccaucaccaguggaugacuaccgaggacaugcugucuguauggaaucgcguuuggaucgaagagaacccuuggauggaagauaagacacaugugagcuccugggaggaggucccauacuugggcaaacgggaagaccaguggugcggcucacugauugggcucacggcaagggccaccugggcuacuaauauccaaguggccauuaaccagguucgaagacuuaucggaaaugagaacuaucuggacuacaugacaagcaugaagcgguucaaaaaugaaucugauccggagggugcacuaugguga

SEQ ID NO: 13368 - RNA, 9879 nt, Artificial Sequence
  derived and/or modified CDS sequence (opt3) from DENV-1__KJ189307__SS-prME
agcgugaccaugcugcucaugcuucugcccacagcauuggcuuuccacuuaacuacgagaggaggggaaccucauaugaucgucuccaagcaggaaaggggaaaaucucugcuauuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcauuuuuccuggcccaugcuaucggcacaucgauuacccaaaagggcaucauauuuauccucuuaaugcuggugacgccaucaauggccaugcggugcgucgggauuggaaaccgcgauuucguggagggucuuagcggcgcgacuuggguagacguuguguuggagcacgggaguugugucacaaccauggcaaagaauaaacccacucuggauaucgaacuacucaagacagaggugaccaacccugccauucugagaaaacuuugcaucgaagcuaagauauccaauacgaccacagacucuagguguccaacucagggagaggccacccugguggaagaacaggaugcaaacuuugucugccggcgcacauucguugaccgaggcugggguaauggguguggauuguuuggcaaaggcagccuccugacuugcgcuaaguucaagugcgugaccaaauuagaggggaagauuguacaguacgaaaaccugaaauauuccgugaucgucacagugcacaccggagaucaacaucagguugguaaugagacuacggaacacggcacaauugccaccaucacuccccaggcgccuaccucagagauccagcucacagacuacggggcccuuacccuggacuguaguccaagaacuggauuggauuuuaacgaaauggugcuacugacaaugaaggagaaaagcuggcucguccauaagcaaugguuccuggaccuuccgcugcccuggacgucuggcgcauccaccucacaggagacuuggaauaggcaggauuugcucgugacauuuaaaaccgcucacgccaagaagcaagaaguaguugugcuggguagccaggagggggcuaugcacacagccuuaacuggcgcaaccgaaauucagacgaguggaaccacaacuauauucgccggccaucugaaaugccggcuaaagauggacaaacucacccugaaggggacaucuuaugucauguguacuggauccuucaaacuugagaaggaaguggcugagacccagcacgguacggucuuggugcaaguuaaguacgagggcacagaugcgccuugcaaaaucccauuuagcacccaggacgaaaagggggugacucagaacggacgucugauuacagcaaaucccaucguaaccgauaaagagaagccugucaacauagaaacugagccacccuucggcgagucguauauugugguuggugccggggaaaaagcucucaagcugucuugguuuaagaaaggcuccucaaucggaaagauguucgaggccaccgcacgcggcgccagaaggauggcuauccuuggggacacagccugggauuuuggaaguauugguggcguguucacgagcgucgggaaacuggugcaucagguauuuggaaccgcauacggcguguuguucuccgguguuucuuggacuaugaagaucgggauuggcauacuccugacaugguuaggacugaauagccggucaaccagucuauccaugacauguaucgcggucggcauggugacucucuaccugggggugaugguccaagcugacagcggaugcguuauuaacuggaaaggccgagaacuuaagugugguucugggaucuuugugaccaacgaggugcacacguggacagaacaguauaaguuccaggccgauucaccgaaacgcuugagugcagccaucggaaaggcuugggaggagggcguaugcgguauuagaagcgccaccaggcuggaaaauauaauguggaaacagaucuccaacgagcucaaucauauucuguuagaaaacgacaugaaguuuacugucgugguuggcgacgcaaaugggauccuggcucaaggcaagaagaugauucggccucagcccauggagcacaaauacucuuggaagucguggggcaaggccaaaaucauaggggcggauauccagaacaccacauucauuaucgacggaccagauacuccugaaugucccgacaaucagcgcgccuggaacauuugggagguggaggauuauggcuuugguaucuucaccacaaauauauggcuuaaguugagagacagcuacacgcaaaugugcgaucacaggcucauguccgcugcaauuaaagacucaaaggccguccaugcugauaugggguauuggaucgaaagugagaaaaacgaaaccuggaagcuggcccgugcaucuuucauugaggugaagacuuguacauggccaaaaagccacacccuaugguccaauggaguucuggaaucagagaugaucauacccaagaucuacggcgguccuauuagccagcauaacuaucggccaggcuacuuuacucagacagcggggccguggcaccucggaaaacuggagcuugacuucgauuugugcgaaggcaccacggugguagucgacgagcacugcgggaaucgaggacccucucugagaacuaccacagugaccggcaagaucauucaugaaugguguugcagguccuguacuuuaccuccacuccgcuuucggggugaggaugggugcugguacggaauggagaucagacccgugaaagaaaaggaggaaaaccuggucaggaguaugguuagcgccggcucuggugagguggacuccuucucacuuggcauacuguguguaaguauuaugaucgaagaggugaugcgcagccgauggucgcggaagauguugaugacagggacccucgcugucuuucugcuacuggugaugggacaacucacauggaaugaccugauccgucuuugcauuaugguuggcgccaacgcauccgauagaauggggaugggaacuaccuauuuggcucugauggccacguucaaaaugaggccuauguuugcagugggcuuacucuuccgccggcugacaucuagagagguccuucugcuaaccaucggucucagccugguggccucaguugaauugccaaacagucuggaggaauuaggggacggacucgcuaugggcauuaugaugcugaaacuucugacugaguuucagccccaccaguuguggaccacacuccugucccuaacuuucauaaaaaccacgcugucucuugauuacgcguggaagacaaccgccauggcacucagcaucgugucccuguuuccguugugucugucaacuacaagccagaaaaccacuugguuaccuguccuccugggcaguuucgggugcaagccacuuacaauguuucugauuaccgaaaauaagaucuggggaaggaaaucuuggcccuugaacgaggguauuauggcuaucggcauaguauccauccuccugagcucgcuacugaagaaugacgugccucuugccgggccccucauugccggaggcaugcugaucgcuuguuauguuauuucagguucuagugcagauuuguccuuagagaaagccgcggaagugagcugggagcaagaagcugagcauucugggacgagccacaacaucccagucgaagugcaggacgauggaacuaugaagauaaaagacgaggagcgagaugacacccugacaauucuccugaaggccacccuucuggcaguauccggcguguacccuaugucaauccccgccacauuguucgucugguauuucuggcagaaaaagaagcagcgcaguggcguucuaugggauacuccaagcccgccugaaguggagcgggcugugcuggacgaugggaucuacaggauucuccaacgaggacugcuuggucguucucaggucggcguggggguuuuucaggacggaguauuccauaccauguggcacgugacgcgcggcgcagucuuaauguaucaggguaaacggcuggaacccuccugggccucagugaagaaagaccucauaaguuacgggggaggcuggagauuucaaggcagcuggaauacaggggaggagguucaggugaucgcggucgaaccaggaaagaaccccaaaaaugugcagacuaccccugguacauucaagaccccagagggcgaaguaggggcuauugccuuggauuuuaagcccggaacuuccggcucuccuaucgucaacagggaggguaaaauuguggggcuguacggaaauggcguugugaccacaucgggcacguaugucagcgcaaucgcccaagcuaaggccucacaggaagggccgcucccagagauagaggacgaaguguucaaaaagcgaaaccugacuaucauggaucuucaccccggauccgguaaaacccggcgcuaccugccugcaauuguuagagaggcuaucaagaggaaguugcggacacuaauucuggccccaacccgaguggucgcgagugaaauggccgaggcacucaaaggcaugcccaucagauaucagacuacagcugugaagucugaacauaccgggcgcgagauaguagacuuaaugugccacgccacguuuacuaugaggcugcuuagcccugugcguguuccgaauuacaacaugauuaucauggaugaggcucauuucacagaccccgcauccaucgccgcccggggauauauuucaaccagagucggcaugggugaagcugcggcaaucuuuaugaccgccacuccaccugggucuguggaggcuuucccccagagcaaugccgugauacaagaugaagagagggacauuccagaacgcaguuggaacuccggauacgauuggaucacagacuuuccuggcaaaaccgucugguucguacccagcauuaagucuggcaaugauaucgcaaacugucugagaaagaacgggaagagagugauacagcucucacggaagacauucgacacugaguaucagaaaacgaagaauaacgacugggauuacguugugaccacagacauuuccgagaugggagccaauuuuagggcugaucgcgucaucgacccacguagaugcuugaaaccggugauccugaaggaugguccugaacggguuauucucgcgggccccaugccagugacugucgccagugcagcucagaggcgcgggcgaaucggaagaaaccaaaauaaagagggcgaccaguacguguauaugggucagccccugaacaaugaugaagaccacgcccauuggaccgaggcaaagaugcuucuagauaacauuaauacaccugaggggauaaucccagcccuguucgaacccgagcgggaaaagaacgcugccauugacggcgaguacagguugcgcggagaagcgagaaaaaccuuuguagaguuaaugaggcggggcgaucugccuguguggcucagcuauaagguugcaucggagggguuccaguacucugaccgucgcuggugcuuugauggagaacgaaauaaccaaguccuggaggaaaauauggacguggagaucuggacuaaagaaggugagagaaagaaacuuaggccgcgguggcuggacgcccgcacguauuccgauccacucgcuuugagagaguucaaggaauuugccgcuggcaggcggagcgugucaggggaccugauccuagagauuggaaaacugccccagcaccucacccuucgagcacagaacgcccuggauaauuuagucauguugcacaacagugaacagggcgguaaggcuuacagacaugccauggaggaacugccugacacaauagagacucucaugcugcuugcacugaucgcgguucucaccgggggcgugacauuguucuuucugucuggaaagggcuuagggaaaaccuccauuggacuacuguguguaacugccagcucagcucuccuuuggauggccaguguggagccccacuggaucgcagcuagcauuauccuggaguucuuuuugaugguccugcucauaccagagccugaucgccaaaggacaccccaggacaaccagcuggccuaugugguuaucggucuucucuucaugauucugacgguggcagccaaugaaaugggcuugcuggagaccacuaagaaagauuuagggaucggacaugucgcugcggagaaccaccaacacgccacaaugcuagacguagaucugcggccagcauccgcuuggacccucuacgccguggccaccacaguuauuacuccuaugaugcgucauacgaucgaaaauaccacagcaaacauaucucuuacugcuauugccaaucaggcggcuauccugaugggcuuggacaaggguuggccgauuagcaaaauggauaucggggugccccugcucgcccugggcugcuacucccaggucaacccacuuaccuuaacagcagccgugcugaugcucgucgcucacuaugcaauaaucggaccuggcuugcaggccaaggcgaccagagaggcucaaaagaggacugccgcagggauuaugaaaaaucccacgguggacggaaucguugccauugaucuggacccagugguauacgacgcuaaguuugaaaaacagcuaggccagaucaugcugcucauacuuuguacaucacagauucuguugaugcgcaccacuugggcccugugcgagucuaucacccucgcaacagguccucugacuaccuuaugggaagggagucccggaaaguucuggaacacaacgaucgcugugucgauggccaauauuuuccggggcagcuaucuugcgggugccggccuggcauuuucccucaugaaaucucuagggggaggccgaagagggaccggagcucaaggcgagacucugggugagaaguggaagaggcaguugaaccagcugucaaaaagcgaguucaauacauacaagcgcuccgggaucauggaggucgaucggagugaagccaaagagggacucaagagaggcgaaaccacuaaacaugcaguuucucgugguacagcuaaacuuaggugguuuguggagcggaaccuggucaagccggagggcaaagugauagacuugggguguggacgcggcggguggagcuauuacugcgccggacugaagaaaguaaccgaagugaagggcuauacgaaaggugggccaggacacgaggaaccuauucccauggccaccuacggcuggaaucucguuaaguuacauucaggcaaagauguguucuuuaugccacccgagaagugugacacacugcuuugcgauaucggggaauccaguccuaacccgacuauugaggagggacgaacccugagaguccuaaagaugguggaacccuggcucagggguaaucaguucuguaucaaaauacugaacccauacaugccuagcgucguggagacauuggaacaaaugcagcggaagcacggcgggaugcugguucgcaauccccucucuagaaacuccacucacgagauguauuggguaucaugcggaaccggcaacaucgugagcgcggucaauaugacaucgaggaugcuucugaaccgauuuaccauggcucaucggaaaccuacuuacgagcgugacguggauuuaggugcagggacgagacacguugccguggaaccagaggucgcuaaucuggacauuaucggacagcgcauugaaaacaucaagaaugagcauaaaucuacauggcacuaugaugaagacaaccccuacaagaccugggccuaucacggcaguuacgaggugaagccuuccggcagcgcaucauccaugguaaauggggugguuagguugcucacuaaaccaugggaugucauucccauggugacccaaaucgccaugacagacacgaccccguucggacagcagcggguguuuaaggagaaagucgacacuagaacaccucgcgcuaagagggguaccacucagauaauggaaguuacagcgaaauggcuguggggcuuccuaucucgaaacaagaagccacggauuuguaccagagaggaauuuacaaggaaagugcgcagcaaugccgcaaucggggcuguauucguggaugagaaccaauggaauagugccaaggaagcagucgaggacgagcguuuuugggaucuugugcaucgggaaagagagcugcacaaacagggaaagugcgccacuugcguuuauaacaugaugggcaaaagggaaaagaagcucggugaguucgggaaagcuaagggaucccgcgccaucugguacauguggcugggcgcgcgauucuuggaauuugaggcacugggcuucaugaaugaggaccauugguuuagccgggaaaacucucucucagggguggagggagaaggucuucacaaacugggcuacauuuuaagagauauaaguaagauccccgggggaaauauguaugccgacgauaccgcuggcugggacacgaggauuaccgaggaugaccugcagaacgaggccaaaaucacagaaauuauggagccugaacaugcauugcucgcuacuuccaucuucaagcugaccuaccagaacaaagucgugcgcguacaaagaccagccaagaaugguacaguuauggaugugauaagccggagggaccagcgugggucuggacaggucggcacuuauggccuaaacaccuuuacgaauauggaggugcagcuuauccgacaaauggaaucggaggggauuuuccugcccucagagcucgaaacaccgaaccuggcugagcgcguguuggauugguuagaaaagcacggagccgagagacugaaacggauggcaaucagcggugacgacugugucguuaagccuauugaugacagguuugcgaccgcccucacugcucuuaaugauaugggcaaagugcgcaaggacaucccccagugggaaccauccaaaggguggaacgauuggcagcagguaccuuucugcagucaccauuuucaccaacugauaaugaaggacggaagagagauugugguccccugucggaaucaggaugagcuagugggcagggcccgaguuucucagggugcaggguggagccugcgugaaacagcuugccucggaaaguccuacgcccaaauguggcaguugauguauuuccauagacgcgaccugcggcuugcagccaacgcgaucuguucagcugugccagucgauugggugcccaccaguaggacuaccuggucuauccacgcccaccaucaguggaugacaacggaggacaugcugagcguauggaauagaguuuggauugaagagaacccuuggauggaagauaaaacccacguguccucaugggaggaggucccauaccucggcaagcgcgaagaccaguggugcggcagcuuaauagggcugacugcacgggccacaugggcuaccaauauccaaguggccauuaaccagguuaggcgauugaucggaaaugagaacuaucuggacuacaugacuucuaugaaaagauuuaagaaugaauccgauccggagggugcacucugguga

SEQ ID NO: 13369 - RNA, 9879 nt, Artificial Sequence
  derived and/or modified CDS sequence (opt3) from DENV-1__KJ189318__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaaacggcggaagugagcugggagcaagaagcugagcauucugggacuagccacaacauacucguugaagugcaggacgauggaaccaugaagauuaaagacgaggagcgagaugacacacugaccauccuucugaaggccacauugcuagcagucuccggcguguacccaaugucaaucccugccacucuguuuguaugguauuucuggcagaaaaagaagcagcgcaguggcgugcucugggauacccccagcccaccggaagucgagcgggcuguucuggacgaugggauuuacagaauacuucaaaggggauuacugggucguucucaggugggcgugggggucuuccaggacggaguguuucauacgauguggcacguuacacgcggcgcaguacucauguaucaggguaaacgguuggaaccuuccugggccucagugaagaaagaccugaucaguuacgggggaggcuggagauuccaaggcagcuggaauacuggggaggagguccaggugauugcgguugaacccggaaagaacccaaaaaaugugcagaccacacccgguaccuuuaagacuccugagggcgaagucggggcuaucgcccucgauuucaagccaggaaccuccggcucucccauugugaacagggaggguaaaaucguagggcuguacggaaauggcgucgugacaacgucgggcacuuauguuagcgcaauagcccaagcuaaggccucacaggaagggccucuuccggagaucgaggacgaaguguuuaaaaagcgaaaccugaccauuauggauuugcacccaggauccgguaaaacacggcgcuaccuacccgcaaucgucagagaggcuauuaagaggaagcugcggacccucaucuuagccccuacucgagugguugcgagugaaauggccgaggcacugaaaggcaugccaauaagauaucagacaaccgcugugaagucugaacauacggggcgcgagauugucgaccuuaugugccacgccacuuucacaaugaggcugcucagccccgugcguguaccuaauuacaacaugaucaucauggaugaggcucauuuuaccgacccggcauccauugccgcccggggauauaucucaaccagagugggcaugggugaagcugcggcaauauucaugacugccacacccccagggucuguugaggcuuuuccucagagcaaugccgucauucaagaugaagagagggacauccccgaacgcaguuggaacuccggauacgauuggauuaccgacuucccaggcaaaacagugugguuugugccuagcaucaagucuggcaaugauauagcaaacuguuugcgaaaaaacgggaagagagucauucagcugucacggaagacuuucgacacggaguaucagaaaaccaagaauaacgacugggauuacguagugacaacugacaucuccgagaugggagccaauuucagggcugaucgcguuaucgacccccguagaugccucaaaccagugauucugaaggaugguccggaacgggucauccuugcgggcccuaugcccgugaccguugccagugcagcucagaggcgcgggcgaauuggaagaaaccaaaauaaagagggcgaccaguacguguauaugggucagccacuaaacaaugaugaagaccacgcccauuggacagaggcaaagaugcuguuggauaacauaaauacccccgaggggaucauuccugccuuauuugaaccagagcgggaaaagagcgcugccaucgacggcgaguacaggcugcgcggagaagcgagaaaaacuuucgucgagcucaugaggcggggcgaucugcccguguggcuuucguauaagguagcaucugagggguuucaguacuccgaccgucgcuggugcuucgauggagaacgaaacaaucaagugcuggaggaaaacauggacguugagaucuggacgaaagaaggugagagaaagaaacucaggccucggugguuggacgcccgcaccuauagcgauccgcuggcucuaagagaguuuaaggaauucgccgcuggcaggcggucagucaguggggaccugauucucgagauaggaaaacuuccacagcaccugacauuacgagcacagaaugccuuggauaaccuggugaugcuccacaauucugaacagggcgguaaggcuuacagacaugccauggaggaacugcccgacacuaucgagacccuuaugcugcucgcauugauugcggugcugacagggggcgucaccuuauuuuuccuauccggaaagggccuggggaaaacuagcaucggacuccuuuguguuacagccucaagugcucuguuguggauggccagcguggagccucacuggauugcagcuuccaucauacuggaauuuuuccucaugguacugcuuauccccgagccagaucgccaaaggacgccucaggacaaccagcucgccuauguggucauuggucuguuguuuaugauccugaccguggcagccaacgaaaugggcuuacuagagacuacaaagaaagaucuggggauuggacauguugcugcggagaaucaccaacacgccaccaugcucgacguggaucuucggcccgcaucugcuuggacccuguacgccgucgccacaacuguaaucacgccaaugaugcgucauaccauagaaaacacaacugcaaauauuagcuugaccgcuaucgccaaccaggcggcuauucugaugggccucgacaaggguuggccuaucuccaaaauggauauaggggugccgcugcuugccuuaggcugcuacucacagguuaauccccugacacucaccgcagccguguugaugcuggucgcucacuaugcaaucauuggaccaggccuacaggccaaggcgacuagagaggcucaaaagaggacggccgcagggaucaugaaaaacccuacaguggacggaauugucgccaucgaucuggaccccgugguuuacgacgcuaaguucgaaaaacagcucggccagauaaugcuucugauuuuguguaccucucagauccugcucaugcgcacuaccugggcccugugcgagaguaucacauuagcaacugguccacuuaccacacugugggaagggucgccuggaaaguuuuggaauacgaccauugcugugagcauggccaacaucuuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacaccuacaagcgcagugggauaauggagguagaucggucugaagccaaagagggacugaagagaggcgaaacuacaaaacaugcagugagccgugguaccgcuaaguugaggugguucgucgagcggaaucugguuaagcccgagggcaaagugauugaccucggguguggacgcggcggguggucauauuacugcgccggauuaaagaaagucacggaagugaagggcuauaccaaaggugggccgggacacgaggaaccaaucccuauggccacauacggcuggaaccugguaaagcuucauuccggcaaagauguguuuuucaugcccccagagaagugugacacucugcuaugcgauauuggggaaaguagccccaauccuaccaucgaggagggacgaacacucagaguucugaagaugguggaaccgugguugagggguaaccaguuuuguauaaaaauccugaaucccuacaugccaucugucguggagacucucgaacaaaugcagcggaagcacggcgggaugcuuguccgcaacccucuguccagaaauucaacccacgagauguauugggugagcugcggaacaggcaacauuguuucggcgguaaacaugaccucuaggauguuacugaaucgauucacuauggcucaucggaaacccacguuugagcgugacguggauuugggugcagggacaagacacgucgccguggaaccugagguugcuaaccucgacaucauuggacagcgcaucgaaaauauuaagaacgagcauaaaaguaccuggcacuacgaugaagacaauccauauaagacuugggccuaccacggcuccuaugaggugaagcccagcggcucagcauccucuauggucaacggggugguaaggcugcuaaccaaaccuugggaugugaucccaaugguuacacaaauagccaugacggacaccacucccuucggacagcagcgggucuuuaaggagaaaguggacacaagaaccccgcgcgcuaagagggguacuacacagauuauggaagugaccgcgaaauggcuuuggggcuuccugagccgaaauaagaagccucggaucuguacaagagaggaauuuacuaggaaaguccgcaguaacgccgcaaucggggcuguuuucguggaugagaaucaauggaacuccgccaaggaagcaguagaggacgagcguuuuugggaucucgugcaucgggaaagagagcugcacaaacagggaaagugcgccaccugcgucuacaauaugaugggcaaaagggaaaagaaguugggugaguucgggaaagcuaagggaagccgcgccauuugguauauguggcugggcgcgcgauuccucgaauuugaggcacuuggcuucaugaacgaggaccauugguuuucucgggaaaauucacugagugggguggagggagaagguuuacacaaacugggcuacauauugagagauaucuccaagauuccagggggaaacauguacgccgacgauacggcuggcugggacaccaggaucacagaggaugaccuccagaaugaggccaaaauuacugauaucauggaacccgagcaugcacugcuagcuaccagcauauucaagcuuacauaucagaacaaaguugugcgcguccaaagaccugccaagaacgguacugugauggacguaaucucucggagggaucagcgugggucgggacagguuggcaccuacggccugaauacguuuacaaacauggaagugcagcucauucgacaaauggagucagaagggaucuuccugccaagcgaguuggagacccccaauuuagcugaacgcguccuggacuggcucgagaagcacggagccgaaagacuuaaacggauggcaauuuccggugacgauuguguggugaagccgaucgacgauagguuugcgacugcccugacagcucuaaacgacaugggcaaaguccgcaaggauauaccucagugggagcccaguaaaggguggaaugacuggcagcagguuccauucugcucucaccauuuucaccaacugauuaugaaggauggaagagaaaucgugguaccuugucggaaccaggacgagcucgugggcagggcccgagucagccagggugcagggugguccuugcgugagaccgcuugccugggaaagucauaugcccaaauguggcagcuuauguacuuccauagacgcgaucugcggcucgcagccaaugcgaucuguagugcugugcccguugacugggugccaacuucuaggaccacauggagcauucacgcccaccaucaguggaugacgaccgaagauauguuauccgucuggaacagaguguggauagaggaaaaucccuggauggaggacaaaacucacguaucaagcugggaagagguuccuuaucugggcaagcgcgaggaccaguggugcggcucuuugaucgggcugacagcacgggccaccugggcuacuaacauucaaguggccaucaaucaggucaggcgacucauuggaaacgaaaauuaccuugauuauaugacauccaugaaaagauuuaagaacgagagugacccagaaggugcacugugguga

SEQ ID NO: 13370 - RNA, 9879 nt, Artificial Sequence
  derived and/or modified CDS sequence (opt3) from DENV-1__KJ189319__SS-prME
agcgugaccaugcugcucaugcuucugccaacagcauuggcuuuccacuuaacuacgcgaggaggggaaccucauaugaucgucuccaagcaggaaaggggaaaaucucugcuguuuaagaccucagccgguguuaacaugugcacacucauugccauggaccugggcgaacuuugugaagauacuaugaccuacaaaugcccacaaauaacagaagcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcagucuggggugcaagccauugacaauguuucucaucaccgaaaauaagauuuggggaaggaaaucuuggccccugaacgaggguaucauggccauaggcaucguguccauucuacugagcucgcuucucaagaaugacgucccucuggccgggcccuugaucgcuggaggcauguuaauugcauguuauguaaucucagguucuagugccgaucugucccucgagaaagcggcugaagugagcugggagcaagaagccgagcauucugggacgagccacaacauacugguugaagugcaggacgauggaacuaugaagauuaaagacgaggagcgagaugacacccuuacaauccuguugaaggcaacccuacuggccgucuccggcguguacccaaugucaaucccugcuacacucuucguaugguauuuuuggcagaaaaagaagcagcgcaguggcgugcugugggauacucccagcccaccggaagucgagcgggcaguucuugacgaugggauuuacagaauauuacaaaggggacugcucggucguucucaggugggcgugggggucuuccaggacggaguguuccauaccauguggcacguuacgcgcggcgccguauugauguaucaggguaaacggcuggaaccuuccugggcgucagugaagaaagaccucaucaguuacgggggaggcuggagauuucaaggcagcuggaauacaggggaggagguccaggugauugcuguugaacccggaaagaaccccaaaaaugugcagacuacccccgguacauucaagaccccugagggcgaagucggggccaucgcacuggauuuuaagccaggaacuuccggcucucccauugugaacagggaggguaaaaucguagggcuuuacggaaauggcgucgugaccacaucgggcacguauguuagcgccauagcucaagccaaggcaucacaggaagggccucugccggagaucgaggacgaaguguucaaaaagcgaaacuugacuauuauggaucuacacccaggauccgguaaaacccggcgcuaccugcccgcuaucgucagagaggccauuaagaggaagcuccggacauuaauccuggcgccuacccgagugguugccagugaaauggcagaggcucuuaaaggcaugccaauaagauaucagacuacagccgugaagucugaacauaccgggcgcgagauugucgaccugaugugccacgcuacguuuacuaugaggcucuugagccccgugcguguaccuaauuacaacaugaucaucauggaugaggcacauuucacagacccggccuccauugccgcucggggauauaucucaaccagagugggcaugggugaagcggcagccauauuuaugaccgcuacucccccagggucuguugaggccuucccucagagcaaugcagucauucaagaugaagagagggacauccccgaacgcaguuggaacuccggauacgauuggauuacagacuuuccaggcaaaaccgugugguucgugccuagcaucaagucuggcaaugauauagccaacugucugcggaaaaacgggaagagagucauucagcucucaagaaagacauuugacacugaguaucagaaaacgaagaauaacgacugggauuacguagugaccacagacaucuccgagaugggagcuaauuucagggcggaucgcguuaucgacccccguagaugccugaaaccagugauucuuaaggaugguccggaacgggucauccuagccggcccuaugcccgugacuguugcaagugcugcccagaggcgcgggcgaauuggaagaaaccaaaauaaagagggcgaccaguacguguauaugggucagccacugaacaaugaugaagaccacgcacauuggaccgaggccaagauguuguuagauaacauaaauacacccgaggggaucauuccugcucuguucgaaccagagcgggaaaagagcgccgcgaucgacggcgaguacaggcuccgcggagaagcaagaaaaaccuuugucgagcugaugaggcggggcgaucuucccguguggcugucguauaagguagccucugagggguuccaguacuccgaccgucgcuggugcuuugauggagaacgaaacaaucaagugcucgaggaaaacauggacguugagaucuggacuaaagaaggugagagaaagaaauugaggccucgguggcuggacgcucgcacguauagcgauccgcuagcccugagagaguucaaggaauuugcugcaggcaggcggucagucaguggggaccucauucuugagauaggaaaacugccacagcacuuaaccuugcgagcccagaaugcucuggauaaccucgugaugcugcacaauucugaacagggcgguaaggccuacagacaugcaauggaggaacuucccgacacaaucgagacucugaugcucuuggcgcugauugccguguuaaccgggggcgucacacuauucuuucuguccggaaagggccucgggaaaaccagcaucggacuucuguguguuacugcuucaagugccuugcuguggauggcaagcguggagccucacuggauugcugccuccaucauacucgaguucuuucugaugguacuucucauccccgagccagaucgccaaaggacaccucaggacaaccagcuggcauauguggucauugguuugcuguucaugaucuuaacgguggccgcuaacgaaaugggccuacuggagaccacuaagaaagaucucgggauuggacauguugcggccgagaaucaccaacacgcaacaaugcuugacguggaucugcggcccgcuucugccuggaccuuguacgccgucgcaaccacaguaaucacuccaaugaugcgucauacgauagaaaacaccacagcuaauauuagccugacugccaucgcgaaccaggcugccauucucaugggccuggacaaggguuggccuaucuccaaaauggauauaggggugccgcuuuuagcacugggcugcuacucacagguuaauccccucaccuugacagccgcugugcugaugcuagucgcacacuaugccaucauuggaccaggccugcaggcgaaggcuaccagagaggcccaaaagaggacugcagccgggaucaugaaaaacccuacgguggacggaauugucgcuaucgaucucgaccccgugguuuacgacgccaaguuugaaaaacagcuuggccagauaaugcuguugauucuguguacaucucagauccuccugaugcgcaccacuugggcauuaugcgagaguaucacccuugcuacagguccacugacuacccucugggaagggucgccuggaaaguucuggaauacaacgauugccgugagcauggcgaacaucuuucggggcuccuaucuagccggugcaggccuggcuuucucuuugaugaaaucacuagggggaggccgaagagggaccggagcccaaggcgagacucucggugagaaguggaagaggcagcuuaaucagcugagcaaauccgaguucaacacauacaagcgcagugggauaauggagguagaucggucugaagcaaaagagggauugaagagaggcgaaaccacuaaacaugcugugagccgugguacagccaagcugaggugguuugucgagcggaaucucguuaagcccgagggcaaagugauugacuuaggguguggacgcggcggguggucauauuacugcgccggacugaagaaagucaccgaagugaagggcuauacgaaaggugggccgggacacgaggaaccaaucccuauggcgaccuacggcuggaaccuuguaaagcugcauuccggcaaagauguguucuuuaugcccccagagaagugugacacacuacucugcgauauuggggaaaguagccccaauccuacuaucgaggagggacgaacccugagaguuuugaagaugguggaaccguggcugagggguaaccaguucuguauaaaaauccucaaucccuacaugccaucugucguggagacacuugaacaaaugcagcggaagcacggcgggaugcugguccgcaacccuuuauccagaaauucaacucacgagauguauugggugagcugcggaaccggcaacauuguuucggcuguaaacaugacaucuaggaugcuguugaaucgauuuaccauggcacaucggaaacccacuuucgagcgugacguggaucucggugccgggacgagacacgucgcuguggaaccugagguugccaaccuggacaucauuggacagcgcaucgaaaauauuaagaacgagcauaaaaguacauggcacuacgaugaagacaauccauauaagaccugggcauaccacggcuccuaugaggugaagcccagcggcucagccuccucuauggucaacggggugguaaggcuacuuacuaaaccuugggaugugaucccaaugguuacccaaauagcuaugacagacacgacccccuuuggacagcagcgggucuucaaggagaaaguggacacuagaacaccgcgcgcgaagagggguaccacucagauuauggaagugacagccaaauggcuguggggcuuucucagccgaaauaagaagccucggaucuguaccagagaggaguucacaaggaaaguccgcaguaacgcagcuaucggggccguuuuuguggaugagaaucaauggaacuccgcaaaggaagccguagaggacgagcguuucugggaucuggugcaucgggaaagagaguugcacaaacagggaaagugcgcuacuugcgucuacaauaugaugggcaaaagggaaaagaagcugggugaguuugggaaagccaagggaagccgcgcgauuugguauauguggcucggcgcacgauuccuugaguucgaggcccugggcuuuaugaacgaggaccauugguucucucgggaaaauucauuaagugggguggagggagaaggucugcacaaauugggcuacauacucagagauaucuccaagauuccagggggaaacauguacgcugacgauaccgccggcugggacacgaggaucaccgaggaugaccugcagaaugaggcaaaaauuacagauaucauggaacccgagcaugcucuacuugccacuagcauauuuaagcugaccuaucagaacaaaguugugcgcguccaaagaccugcuaagaacgguacagugauggacguaaucucucggagggaucagcgugggucgggacagguuggcacuuacggccucaauaccuucacgaacauggaagugcagcugauucgacaaauggagucagaagggaucuuuuugccaagcgaguuagagacacccaaucuggccgaacgcguccucgacuggcuugagaagcacggagcagaaagacugaaacggauggcgauuuccggugacgauuguguggugaagccgaucgacgauagguucgccaccgcucuaacugcccugaacgacaugggcaaaguccgcaaggauauaccucagugggagcccaguaaaggguggaaugacuggcagcagguuccauuuugcucucaccauuuccaccaacucauuaugaaggauggaagagaaaucgugguaccuugucggaaccaggacgaguuggugggcagggcacgagucagccagggugcuggguggucccugcgugagacagccugccuuggaaagucauaugcacaaauguggcagcugauguacuuucauagacgcgaucuccgguuagccgcgaaugcuaucuguagugccgugcccguugacugggugccaaccucuaggacuaccuggagcauucacgcacaccaucaguggaugacaacggaagauaugcuguccgucuggaacagaguguggauagaggaaaaucccuggauggaggacaaaacccacguaucaagcugggaagagguuccuuauuugggcaagcgcgaggaccaguggugcggcucucugaucgggcucacugcccgggcuacaugggccaccaacauucaaguggcaaucaaucaggucaggcgacuuauuggaaacgaaaauuaccuggauuauaugacuuccaugaaaagauucaagaacgagagugacccagaaggugcucuaugguga

SEQ ID NO: 13371 - RNA, 9879 nt, Artificial Sequence
  derived and/or modified CDS sequence (opt3) from DENV-1__KJ189320__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauaaccgagguagaucggucugaagcaaaagagggacugaagagaggcgaaacuacaaaacaugcugugagccgugguaccgccaaguugaggugguucgucgagcggaaucugguuaagcccgagggcaaagugauugaccucggguguggacgcggcggguggucauauuacugcgccggauuaaagaaagucacggaagugaagggcuauaccaaaggugggccgggacacgaggaaccaaucccuauggcgacauacggcuggaaccugguaaagcuucauuccggcaaagauguguuuuucaugcccccagagaagugugacacucugcuaugcgauauuggggaaaguagccccaauccuaccaucgaggagggacgaacacucagaguucugaagaugguggaaccgugguugagggguaaccaguuuuguauaaaaauccugaaucccuacaugccaucugucguggagacucucgaacaaaugcagcggaagcacggcgggaugcuuguccgcaacccucuguccagaaauucaacccacgagauguauugggugagcugcggaacaggcaacauuguuucggcuguaaacaugaccucuaggauguuacugaaucgauucacuauggcacaucggaaacccacguuugagcgugacguggauuugggugccgggacaagacacgucgcuguggaaccugagguugccaaccucgacaucauuggacagcgcaucgaaaauauuaagaacgagcauaaaaguaccuggcacuacgaugaagacaauccauauaagacuugggcauaccacggcuccuaugaggugaagcccagcggcucagccuccucuauggucaacggggugguaaggcugcuaaccaaaccuugggaugugaucccaaugguuacacaaauagcuaugacggacaccacucccuucggacagcagcgggucuuuaaggagaaaguggacacaagaaccccgcgcgcgaagagggguacuacacagauuauggaagugaccgccaaauggcuuuggggcuuccugagccgaaauaagaagccucggaucuguacaagagaggaauuuacuaggaaaguccgcaguaacgcagcuaucggggccguuuucguggaugagaaucaauggaacuccgcaaaggaagccguagaggacgagcguuuuugggaucucgugcaucgggaaagagagcugcacaaacagggaaagugcgcuaccugcgucuacaauaugaugggcaaaagggaaaagaaguugggugaguucgggaaagccaagggaagccgcgcgauuugguauauguggcugggcgcacgauuccucgaauuugaggcccuuggcuucaugaacgaggaccauugguuuucucgggaaaauucacugagugggguggagggagaagguuuacacaaacugggcuacauauugagagauaucuccaagauuccagggggaaacauguacgcugacgauacggccggcugggacaccaggaucacagaggaugaccuccagaaugaggcaaaaauuacugauaucauggaacccgagcaugcucugcuagccaccagcauauucaagcuuacauaucagaacaaaguugugcgcguccaaagaccugcuaagaacgguacugugauggacguaaucucucggagggaucagcgugggucgggacagguuggcaccuacggccugaauacguuuacaaacauggaagugcagcucauucgacaaauggagucagaagggaucuuccugccaagcgaguuggagacccccaauuuagccgaacgcguccuggacuggcucgagaagcacggagcagaaagacuuaaacggauggcgauuuccggugacgauuguguggugaagccgaucgacgauagguuugccacugcucugacagcccuaaacgacaugggcaaaguccgcaaggauauaccucagugggagcccaguaaaggguggaaugacuggcagcagguuccauucugcucucaccauuuucaccaacugauuaugaaggauggaagagaaaucgugguaccuugucggaaccaggacgagcucgugggcagggcacgagucagccagggugcugggugguccuugcgugagaccgccugccugggaaagucauaugcacaaauguggcagcuuauguacuuccauagacgcgaucugcggcucgccgcgaaugcuaucuguagugccgugcccguugacugggugccaacuucuaggaccacauggagcauucacgcacaccaucaguggaugacgaccgaagauauguuauccgucuggaacagaguguggauagaggaaaaucccuggauggaggacaaaacucacguaucaagcugggaagagguuccuuaucugggcaagcgcgaggaccaguggugcggcucuuugaucgggcugacagcccgggcuaccugggccacuaacauucaaguggcaaucaaucaggucaggcgacucauuggaaacgaaaauuaccuugauuauaugacauccaugaaaagauuuaagaacgagagugacccagaaggugcucugugguga

SEQ ID NO: 13372 - RNA, 9879 nt, Artificial Sequence
  derived and/or modified CDS sequence (opt3) from DENV-1__KJ189323__SS-prME
agcgugaccaugcugcucaugcuucugcccacagcauuggcuuuccacuuaacuacgcggggcggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacaaauaacagaagcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggaccuuucaaauuggagaaggaaguggcugagacccagcacgguacgguccuggugcaaguuaaguacgagggcacagaugcgccaugcaaaauccccuucuccacccaggacgaaaagggggugacucagaacggacgucucauuacagcaaauccuaucguaaccgauaaagagaagccagucaacauagaaacugagcccccguuuggcgagagcuauauugugguuggugccggggaaaaagcucugaaacuuucgugguucaagaaaggaucuuccaucggaaagauguuugaggccaccgcacgcggcgccagaaggauggcuauccugggggacacagccugggauuucggaucaauugguggcguguuuacgagugucgggaaauuggugcaucagguauucggaaccgcauacggcgugcucuuuagcgguguuuccuggacuaugaagaucgggauuggcauacuguuaacauggcugggacuaaauucucggagcaccucacucaguaugacauguaucgcggucggcauggugacucuguaccuuggggugaugguccaagcugacuccggaugcguuauuaacuggaaaggccgagaauugaagugugguagcgggaucuucgugaccaacgaggugcacacguggacagaacaguauaaguuucaggccgauucuccuaaacgccugucagcagccaucggaaaggcuugggaggagggcguaugcgguauuagaagugccaccaggcucgaaaauauaauguggaaacagaucagcaacgagcugaaucauauuuuacuggaaaacgacaugaaguucacugucgugguuggcgacgcaaaugggauccuugcucaaggcaagaagaugauucggccccagccaauggagcacaaauacuccuggaagucuuggggcaaggccaaaaucauaggggcggauauccagaacaccacauuuauuaucgacggaccugauacucccgaauguccagacaaucagcgcgccuggaacauuugggagguggaggauuauggcuucgguaucuuuaccacaaauauaugguugaagcucagagacucguacacgcaaaugugcgaucacaggcugaugagcgcugcaauuaaagacuccaaggccguccaugcugauaugggguauuggaucgaaucagagaaaaacgaaaccuggaagcuagcccgugcaaguuucauugaggugaagacuuguacauggcccaaaucucacacccuguggagcaauggaguucucgaauccgagaugaucauaccuaagaucuacggcgguccaauuucacagcauaacuaucggccgggcuacuucacucagacagcggggcccuggcaccugggaaaacuugaguuggacuuugaucugugcgaaggcaccacggugguagucgacgagcacugcgggaaucgaggaccuagcuuaagaacuaccacagugaccggcaagaucauucaugaaugguguugcaggucuuguacucucccaccccugcgcuuccggggugaggaugggugcugguacggaauggagaucagaccugugaaagaaaaggaggaaaaccuugucagguccaugguuagugccggcagcggugagguggacucuuuuucccugggcauauuguguguaucaauuaugaucgaagaggugaugcgcagucgauggagccggaagaugcucaugacagggacccuggcugucuuccuacugcucgugaugggacaacugacauggaaugaccuuauccguuugugcauuaugguuggcgccaacgcaucggauagaauggggaugggaacuaccuaucuggcuuuaauggccacguuuaaaaugaggccaauguucgcagugggccuccuguuucgccggcuuacauccagagagguccugcuacucaccaucggucugucuuugguggccagcguugaacugcccaacucauuagaggaacucggggacggacuggcuaugggcauuaugaugcuuaagcuguugacugaguuccagccgcaccagcucuggaccacacugcuaagucugacuuuuauaaaaaccacgcuuucccucgauuacgcguggaagacaaccgccauggcacugucuaucgugagcuuguucccucuguguuuauccacuacaucacagaaaaccacuuggcucccaguccugcuuggcagcuuugggugcaagccccugacaauguucuugauuaccgaaaauaagaucuggggaaggaaaaguuggccucucaacgaggguauuauggcuaucggcauaguaucuauccugcuauccagccugcuuaagaaugacgugccccucgccgggccacugauugccggaggcauguugaucgcuuguuauguuauuucggguucaucugcagauuuaagucuggagaaagccgcggaaguguccugggagcaagaagcugagcauagcgggacgucucacaacauccucgucgaagugcaggacgauggaacuaugaagauaaaagacgaggagcgagaugacacccugacaauucuucugaaggccaccuugcuagcaguaagcggcguguacccuauguccauccccgccacacuguuugucugguauuucuggcagaaaaagaagcagcgcucaggcguucucugggauacuccaaguccgccugaaguggagcgggcugugcuggacgaugggaucuacaggauucuucaacgaggauuacugggucguagccaggucggcguggggguuuuccagggaggcguauuucauaccauguggcacgugacgcgcggugcaguccucauguaucaggggaaacgguuggaacccucuugggccuccgugaagaaagaccugauaucauacggaggcggcuggagauuccaagggaguuggaauacaggagaggagguucaggugaucgcggucgaaccagguaagaaccccaaaaaugugcagacuaccccuggcacauuuaagaccccagagggggaaguaggagcuauugcccucgacuucaagcccggcacuagcgguuccccuaucgucaacagggaggggaaaauugugggacuguacggcaauggcguugugaccacaucugggacguaugucucggcaaucgcccaagcuaaggccagccaggaaggaccgcuuccagagauagaggaugaaguguuuaaaaagcgaaaccugacuaucauggacuugcaccccgguucaggcaaaacccggcgcuaccuaccugcaauuguuagagaggcuaucaagaggaagcugcggacacucauuuuagccccaacccgaguggucgcguccgaaauggccgaggcacugaaagggaugcccaucagauaucagacuacagcugugaagagugaacauaccggacgcgagauaguagaucuuaugugccacgccacguucacuaugaggcugcucucuccugugcguguuccgaauuacaacaugauuaucauggacgaggcucauuuuacagaucccgcaagcaucgccgcccggggcuauauuuccaccagagucgguaugggggaagcugcggcaaucuucaugaccgccacuccaccuggaucaguggaggcuuuuccccagucuaaugccgugauacaagacgaagagagggauauuccagaacgcagcuggaacaguggcuacgacuggaucacagauuucccuggcaaaaccgucugguuuguacccuccauuaagagcgggaaugacaucgcaaacuguuugagaaagaacggaaagagagugauacagcugucucggaagacauucgauacugaguaucagaaaacgaagaauaacgacugggacuacguugugaccacagauauuucagagaugggugccaauuucagggcugaccgcgucaucgauccacguagaugccucaaaccggugauccugaaggacggcccugaacggguuauucuugcggggcccaugccagugacugucgccuccgcagcucagaggcgcggacgaaucggcagaaaccaaaauaaagagggugaucaguacguguauauggggcagccccuaaacaaugacgaagaucacgcccauuggaccgaggcaaagaugcuguuggacaacauuaauacaccugagggcauaaucccagccuuauuugaacccgagcgggaaaagagugcugccauugauggagaguacaggcugcgcggcgaagcgagaaaaaccuucguagagcucaugaggagaggggaccugccuguguggcuuagcuauaagguugcaucggagggauuucaguacucugaucgucgcuggugcuucgacggugaacgaaacaaucaaguccuggaggaaaacauggauguggagaucuggacuaaagaaggcgagagaaagaaacucaggccgcggugguuggacgcccgcacguauuccgacccacuggcucuaagagaguuuaaggaguucgccgcugggaggcggagcgugucaggagaucugauccucgagauuggcaaacuuccccagcaccugaccuuacgagcacagaaugccuuggacaaccuggucaugcuccacaauagugaacagggugggaaggcuuacagacaugccauggaggaacugccugauacaauagagacucuuaugcugcucgcauugaucgcgguucugaccggcggagugacauuauuuuuccuaucuggcaaggggcugggaaaaaccuccauuggucuccuuuguguaacugccagcucagcucuguuguggauggccaguguggagccccacuggaucgcagcuagcauuauccuggaauuuuuccucaugguccugcuuauaccagagccugaccgccaaaggacaccccaggauaaccagcucgccuaugugguuaucggccuguuguuuaugauucugacgguggcagccaacgaaaugggguuacuagagaccacuaagaaagaccugggaaucggccaugucgcugcggagaaucaccaacacgccacaaugcucgauguagaccuucggccagcauccgcuuggacccuguacgccguggccaccacaguuauuacuccuaugaugcgucauacgaucgaaaacaccacagcaaauauaucuuugacugcuauugccaaccaggcggcuauccugaugggucucgauaagggguggccgauuagcaaaauggacaucggcgugccccugcuugccuuaggaugcuacucccaggucaauccacugacccucacagcagccguguugaugcuggucgcucacuaugcaauaaucggcccugggcuacaggccaaggcgaccagagaggcucaaaagaggacugccgcaggaauuaugaaaaaccccacgguggauggcaucguugccauugaccuggauccagugguauacgacgcuaaguucgaaaaacagcucggucagaucaugcuucugauauuguguacaucacagauucugcucaugcgcaccacuugggcccugugcgagucuaucaccuuagcaacagggccucuuacuacccugugggaaggaagucccggcaaguuuuggaauacaacgaucgcugugucgauggccaacauuuuccgggguagcuaucucgcgggcgccgggcuagcauucucccugaugaaaucuuugggaggcgggcgaagaggaaccggcgcucaaggugagacucugggggagaaguggaagaggcagcucaaucagcuuucaaaaagcgaauuuaacacauacaagcgcuccggaaucauggaggucgaccggagugaagccaaagagggccugaagagaggugaaaccacuaaacaugcaguuucucguggcacagcuaaguugaggugguucguggagcggaaucuggucaagccggaggggaaagugauagaucucggauguggccgcgggggauggagcuauuacugcgccggcuuaaagaaaguaaccgaagugaaggguuauacgaaagggggaccaggccacgaggaaccuauucccauggccaccuacggcuggaaccugguuaaacuucauucagggaaagacguguuuuucaugccacccgagaagugugauacacugcuaugcgacaucggagaauccaguccuaauccgacuauugaggagggucgaacccucagaguccugaagaugguggaacccugguugaggggcaaccaguuuuguaucaaaauacugaauccauacaugccuagcgucguggagacacucgaacaaaugcagcggaagcacgggggaaugcuuguucgcaacccccugucuagaaauuccacucacgagauguauuggguaucaugcggcaccgguaacaucgugagcgcggucaacaugacaucgaggauguuacugaaucgauucaccauggcucaucggaaaccuacuuacgagcgugauguggacuugggggcaggaacgagacacguugccguggaaccagaggucgcuaaccucgauauuaucggccagcgcauugaaaauaucaagaacgagcauaaaucuacauggcacuaugacgaagauaaucccuacaagaccugggccuaucacggcaguuacgaggugaggccuuccgggagcgcaucauccaugguaaacggagugguucggcugcuaacuaagccaugggacgucauucccauggugacccaaaucgccaugacagauacgaccccguuuggucagcagagaguguucaaagagaaggucgacacucgcacaccuagggcuaaacgaggcaccacucagauaauggaaguuacagcgaaguggcuuuggggguuucugucucggaauaaaaagccaagaauuuguaccagggaggaguucacacgcaaggugcguagcaacgccgcaaucggagcuguauuuguggacgagaaucaauggaacagugccaaagaagcagucgaggaugagcgguucugggaccucgugcauagagaaagggagcugcacaagcagggcaaaugcgccacuugcguuuauaauaugauggguaagcgcgagaaaaaguugggggaguuuggaaaggcuaaaggcucccgagccaucugguacauguggcugggcgcgcgguuccucgaguucgaggcacuuggguuuaugaacgaggaucauugguucagcagagaaaauucucugucaggaguggagggugaaggcuuacacaagcugggguacauuuugagggacauaaguaaaauccccggaggcaacauguaugccgaugacaccgcugguugggauacgcgcauuaccgaggacgaucuccagaaugaggccaagaucacagaaauuauggagccugaacaugcacugcuagcuacuuccaucuuuaaacuuaccuaccagaacaaggucgugagaguacaacggccagccaaaaacgggacaguuauggacgugauaagcaggcgugaucagcgaggaucuggccaggucggcacuuaugggcugaauaccuucacgaacauggaggugcagcucauccgccaaauggaaucggagggaauuuuucugcccucagaguuggaaacaccgaauuuagcugagagagugcuggacuggcucgaaaagcacggugccgagcggcuuaagaggauggcaaucagcggcgaugacugugucguuaaaccuauugacgaucgcuucgcgaccgcccugacugcucuaaacgacauggggaaggugagaaaagauaucccccagugggaaccauccaagggauggaaugacuggcagcagguaccuuuuugcagucaccauuuccaccaacugauaaugaaagauggccgggagauugugguccccuguaggaaccaggacgagcucgugggucgagcccguguuucucagggggcaggauggagcuugagagaaacagcuugccugggcaaguccuacgcccaaauguggcagcuuauguauuuucaucgccgggaucugaggcucgcagccaaugcgaucuguucagcugugccagucgacugggugcccaccaguagaacuaccuggucuauccacgcccaccaucaguggaugacaacggaggauauguuaagcguauggaaccgcguuuggauugaagagaauccuuggauggaagacaagacccacguguccucaugggaggaggucccauaccugggcaaacgggaagaucaguggugcgggagcuugauaggacugacugcaagggccacaugggcuaccaacauccaaguggccauuaaucagguucgaagacucaucgguaacgagaauuaucuugacuacaugacuucuaugaagcgguucaaaaacgaauccgacccggagggcgcacugugguga

SEQ ID NO: 13373 - RNA, 9879 nt, Artificial Sequence
  derived and/or modified CDS sequence (opt3) from DENV-1__KJ189324__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccacggagccacacccugugguccaauggaguucucgaaucagagaugaucauacccaaaaucuacggcgguccuauuagccagcauaacuaucgaccaggcuacuucacucagacagcggggccguggcaccugggaaagcuugaguuggacuuugaucugugcgaaggcaccacggugguagucgacgagcacugcgggaauagaggacccucuuuaaggacuaccacagugaccggcaaaaucauucaugaaugguguugccgcuccuguacucucccuccacugcgguucagaggugaggaugggugcugguacggaauggagaucaggcccgugaaggaaaaagaggaaaaccuuguccgcaguaugguuagcgccggcucuggugagguggacuccuuuucacugggcauauugugugcuaguauuaugaucgaagagguaaugcgaagccgguggucgcguaagaugcucaugacagggacccuggccguguuccuacugcucgucaugggacaacugacauggaaugaccuuaucagauugugcauuauggugggcgcaaacgcuuccgauaggauggggaugggaacuaccuaucuggccuuaauggcaacguuuaagaugcgcccuauguucgccguuggccuccuguuucggagacuuacaucuagggaggugcugcuacucaccaucggucugagcuuggucgcuucaguggaacugccaaacaguuuagaggaacucggggacggacuggcgaugggcauuaugaugcuuaaacuguugacugaguuccagccccaccagcucuggaccacacugcuaucccugacuuuuauaaagaccacgcuuucucucgauuacgccuggaaaacaaccgcaauggcucugagcaucguuuccuuguucccgcuguguuuaucaacuacaagccagaagaccacuuggcucccugugcugcuuggcaguuuugggugcaaaccacugacaauguucuugauuaccgaaaauaagaucuggggacgaaagucuuggccccucaacgaggguauuauggccaucggcauagucuccauccugcuaagcucgcugcuuaaaaaugacguaccucucgccgggccccugauugcuggaggcauguugaucgcauguuaugugauuucagguucuagugccgauuuaucccuggagaaggcggcugaaguuagcugggagcaagaagccgagcauucugggacgagccacaacauccucguggaaguccaggacgauggaacuaugaaaauaaaggacgaggagcgcgaugacacccugacaauucuucugaaagcaaccuugcuagccguguccggcguauacccaaugucaaucccugcuacacuguuugugugguauuucuggcagaagaaaaagcagcggaguggcguccucugggauacucccagcccaccggaaguugagagagcagugcuggacgaugggaucuacaggauucuucaacguggauuacugggucgcucucaggugggcgucgggguguuccaggacggaguuuuucauaccauguggcacguaacgcggggcgccgugcucauguaucaggguaagagauuggaaccuuccugggcgucagucaaaaaggaccugauaaguuacgggggaggcuggagguuccaaggcagcuggaauacaggggaggaggugcagguuaucgcuguggaacccggaaaaaacccaaagaauguccagacuacccccgguacauuuaaaaccccugagggcgaagugggggccauugcacucgauuucaagccaggaacuuccggcucucccaucguaaaccgagaggguaagauugucgggcuguacggaaauggcgugguuaccacaucgggcacguaugugagcgccaucgcucaagccaaagcaucacaggaagggccucuuccggagauagaggacgaagucuuuaagaaacggaaccugacuaucauggauuugcacccaggauccgguaagacccgcagauaccuacccgcuauugugagggaggccaucaaacggaagcugcgaacacucauuuuagcgccuaccagaguuguggccagugaaauggcagaggcucugaagggcaugccaauccgcuaucagacuacagccgucaaaucugaacauaccgggagggagauaguggaccuuaugugccacgcuacguucacuaugcgucugcucagccccguacgggugccuaauuacaacaugauuaucauggaugaggcacauuuuacagacccggccuccaucgccgcuagaggauauauuucaaccaggguuggcaugggugaagcggcagccaucuucaugaccgcuacucccccagggucugucgaggccuuuccucagagcaaugcagugauacaagaugaagagcgcgacauucccgaacgaaguuggaacuccggauacgauuggaucacagacuucccaggcaagaccgugugguuugucccuagcauuaaaucuggcaaugauaucgccaacuguuugagaaagaacgggaaacggguaauacagcugucaaggaagacauucgacacugaguaucagaagacgaaaaauaacgacugggauuacgugguuaccacagacauuuccgagaugggagcuaauuuccgcgcggaucgugugaucgaccccagacggugccucaagccagucauccugaaagaugguccggaaagggugauucuugccggcccuaugcccguuacuguggcaagugcugcccagcgccgagggagaaucggacggaaccaaaauaaggagggcgaccaguacgucuauaugggucagccacuaaacaaugaugaagaccacgcacauuggaccgaggccaaaaugcuguuggauaacauuaauacacccgaggggauaaucccugcuuuauuugaaccagagagggaaaagagcgccgcgauugacggcgaguaccgccugagaggagaagcaaggaagaccuucguggagcucaugcggcguggcgaucugcccguauggcuuucguauaaaguggccucugagggguuucaguacuccgaccgccgauggugcuucgauggagaaagaaacaaucaaguucuggaggaaaacauggacgucgagaucuggacuaaggaaggugagaggaaaaagcuccggccucgcugguuggacgcuagaacguauagcgauccgcuggcccuaagggaguuuaaagaauucgcugcaggccggcgaucagugaguggggaccugauccucgagauuggaaagcuuccacagcaccugaccuuaagagcccagaaugcuuuggauaaccuggugaugcuccacaauucugaacagggcgguaaagccuaccgccaugcaauggaggaacugcccgacacaauagagacucuuaugcugcucgcguugaucgccguccugaccgggggcguuacauuauuuuuccuauccggaaagggccuggggaagaccagcauuggacuccuuugugugacugcuucaagugcccuguuguggauggcaagcguagagccucacuggaucgcugccuccauuauccuggaauuuuuccucauggugcugcuuauacccgagccagauaggcaacggacaccucaggacaaccagcucgcauaugucgugaucggucuguuguuuaugauucugacgguugccgcuaacgaaaugggcuuacuagagaccacuaaaaaggaucuggggaucggacauguggcggccgagaaucaccaacacgcaacaaugcucgacgucgaucuucgucccgcuucugccuggacccuguacgccguagcaaccacagugauuacuccaaugaugagacauacgaucgaaaacaccacagcuaauauaagcuugacugccauugcgaaccaggcugccauccugaugggccucgacaaagguuggccuauuuccaagauggauaucgggguuccgcugcuugcauuaggcugcuacucacaggugaauccccugacccucacagccgcugucuugaugcugguggcacacuaugccauaaucggaccaggccuacaggcgaaagcuaccagggaggcccaaaagcgcacugcagccgggauuaugaagaacccuacggucgacggaaucguggcuauugaucuggaccccguuguguacgacgccaaauucgaaaagcagcucggccagaucaugcuucugauauuguguacaucucagauucugcucaugcggaccacuugggcacugugcgagaguaucaccuuagcuacagguccacuuacuacccugugggaagggucgccuggaaaauuuuggaauacaacgaucgccguaagcauggcgaacauuuuccgaggcuccuaucucgccggugcaggccuagcuuucucucugaugaagucauuggggggaggcagaagggggaccggagcccaaggcgagacucugggugagaaauggaagcgccagcucaaucagcuuagcaaguccgaauuuaacacauacaaacggagugggaucauggagguggauagaucugaagcaaaggagggacugaaacguggcgaaaccacuaagcaugcugucagcagggguacagccaaauugcggugguucguugagcgcaaucuggugaagcccgagggcaaggucauagaccucggguguggacgaggcggguggucauauuacugcgccggauuaaaaaaggugaccgaaguaaaaggcuauacgaagggugggccgggacacgaggaaccaauuccuauggcgaccuacggcuggaaccuggugaaacuucauuccggcaaggauguuuuuuucaugcccccagagaaaugugacacacugcuaugcgauaucggggaaaguagccccaauccuacuauugaggagggaagaacccucagggugcugaagauggucgaaccgugguugcgggguaaccaguuuuguaucaagauacugaaucccuacaugccaucuguggucgagacacucgaacaaaugcagcgcaaacacggcgggaugcuugugagaaacccucuguccaggaauucaacucacgagauguauuggguuagcugcggaaccggcaacaucguaucggcugugaacaugacaucucgaauguuacugaaucgguucaccauggcacaucguaagcccacuuacgagagagacgucgauuugggugccgggacgcgccacguggcuguugaaccugagguggccaaccucgacauuaucggacagaggauugaaaauaucaaaaacgagcauaagaguacauggcacuaugaugaagacaauccauacaaaaccugggcauaucacggcuccuacgaggucaagcccagcggcucagccuccucuauggugaacgggguagugcggcugcuaacuaagccuugggauguuauuccaauggucacccaaaucgcuaugacagacacgacccccuuuggacagcagagaguguucaaagagaagguggacacucgcacaccgagggcgaaacgagguaccacucagauaauggaagucacagccaaguggcuuuggggcuuucugagccggaauaaaaagccuagaauuuguaccagggaggaauucacacgcaagguucguaguaacgcagcuaucggggccguguuuguagaugagaaucaauggaacuccgcaaaagaagccguggaggacgagcgguucugggaucucguccauagagaaagggagcugcacaagcagggaaaaugcgcuacuugcguguauaauaugaugggcaagcgcgaaaaaaaguugggugaguuugggaaggccaaaggaagccgagcgaucugguacauguggcugggcgcacgguuccucgaauucgaggcccuuggcuuuaugaacgaggaccauugguucucuagagaaaauucacugagugggguugagggagaagguuuacacaagcugggcuacauuuugagggauauauccaaaaucccagggggaaacauguaugcugacgauaccgccggcugggacacgcgcauuaccgaggaugaccuccagaaugaggcaaagaucacagaaauuauggagcccgaacaugcucugcuagccacuagcaucuuuaaacuuaccuaccagaacaagguggucagagugcaacggccugcuaaaaacgguacaguaauggauguuauaucuaggcgugaccagcgagggucgggacaggugggcacuuauggccugaauaccuucacgaacauggagguccagcucauccgccaaauggaaucagaggagauuuuucugccaagcgaauuggagacacccaauuuagccgaaagagugcuggauuggcucgagaagcacggggcagaacggcuuaagaggauggcgaucuccggagacgacuguguggucaaaccgauugaugaccgcuucgccaccgcucugacugcccuaaacgauauggguaagguuagaaaagacaucccucagugggagcccaguaagggcuggaaugauuggcagcaggugccauuuugcucucaccauuuccaccaacugauaaugaaagacgggcgggagauuguagugccuuguaggaaccaggaugaacucgucggacgagcacgugugagccagggcgcugguugguccuugagagagacagccugccuggggaagucauacgcacaaauguggcagcuuauguauuuucaucgccgggaccugaggcucgccgcgaaugcuaucuguagugccguucccguggauugggucccaaccucuagaacuaccuggagcauccacgcacaccaucaguggaugacaacggaagacauguuauccguguggaaccgcguauggauugaggaaaaucccuggauggaggauaagacccacguuucaagcugggaggaagugccuuaccugggaaaacgggaggaccaguggugcggcucuuugauaggccugacugccagggcuacaugggccaccaacauccaagucgcaauuaaucaggugcgaagacucaucgggaacgaaaauuaucuugacuacaugacuuccaugaagcgguucaaaaacgagagugauccagagggagcucugugguga

SEQ ID NO: 13374 - RNA, 9879 nt, Artificial Sequence
  derived and/or modified CDS sequence (opt3) from DENV-1__KJ189325__SS-prME
agcgugaccaugcugcucaugcuucugcccacagcauuggcuuuccacuuaacuacgagaggaggggaaccucauaugaucgucuccaagcaggaaaggggaaaaucucuguuguuuaagaccucagccgguguuaacaugugcacccucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcacgaucuucauauuacugaugcuugugacuccaucaauggccaugcggugcgucgggaucggaaaccgcgauuuuguggaggguuugagcggcgcgacauggguugacguugugcuggagcacgggaguugugucaccacuauggcaaagaauaaacccacacuagauauugaacuccugaagaccgaggugacgaacccugccauccuuagaaaacugugcauugaagcuaagaucuccaauaccacaacugacucuagguguccaacccagggagaggccacauugguggaagaacaggaugcaaacuucgucugccggcgcacuuuuguugaccgaggcugggguaauggguguggacucuucggcaaaggcagccuguuaaccugcgcuaaguuuaagugcgugacaaaacuggaggggaagauaguacaguacgaaaaccucaaauauuccgugauugucaccgugcacacuggagaucaacaucagguugguaaugagacgacagaacacggcaccaucgccacuauuaccccacaggcgccuacaucagagauccagcuuaccgacuacggggcccugacuuuggacuguaguccaagaacaggacuagauuucaacgaaauggugcugcucacgaugaaggagaaaagcuggcugguccauaagcaaugguuucuugaccugccguugcccuggaccucuggcgcauccacuucacaggagacauggaauaggcaggaucuccuggugaccuucaaaacagcucacgccaagaagcaagaaguaguuguguuagguagccaggagggggcuaugcacacugcccugaccggcgcaacggaaauccagaccaguggaacaacuaccauuuuugccggccaucuaaaaugccggcucaagauggacaaacugacacuuaaggggacuucuuaugucauguguaccggauccuucaaauuggagaaggaaguggcugagacgcagcacgguacaguccuggugcaaguuaaguacgagggcaccgaugcgccuugcaaaauaccauucagcacucaggacgaaaagggggugacacagaacggacgucucaucaccgcaaaucccauuguaacugauaaagagaagccugucaacaucgaaaccgagccacccuuuggcgagucguauauagugguuggugccggggaaaaagcucugaaacuuucuugguucaagaaaggcuccucaauuggaaagauguuugaggccacagcacgcggcgccagaaggauggcuauccugggggacacggccugggauuucggaaguaucgguggcguguuuaccagcgucgggaaauuggugcaucagguauucggaacugcauacggcgugcucuuuuccgguguuucuuggacaaugaagauugggaucggcauucuguuaaccuggcugggacuaaauagccggucaacaagucucuccaugacuuguauagcggucggcauggugacccuguaccuuggggugaugguccaagcugacagcggaugcguuaucaacuggaaaggccgagaauugaagugugguucugggauuuucgugacgaacgaggugcacacauggaccgaacaguauaaguuucaggccgauucaccgaaacgccugagugcagccaucggaaaggcuugggaggagggcguaugcgguaucagaagcgccacuaggcucgaaaauauuauguggaaacagauauccaacgagcugaaucauaucuuacuggaaaacgacaugaaguucaccgucgugguuggcgacgcaaaugggauucuugcucaaggcaagaagaugauccggccucagcccauggagcacaaauacucuuggaagucguggggcaaggccaaaauuaucggggcggauauacagaacacaacuuuuaucauugacggaccagauaccccugaaugucccgacaaucagcgcgccuggaacaucugggagguggaggauuauggcuucgguauuuuuacaacgaauaucugguugaagcucagagacagcuacacccaaaugugcgaucacaggcugauguccgcugcaauaaaagacucaaaggccguccaugcugauaugggguauuggauugaaagugagaaaaacgaaacuuggaagcuagcccgugcaucuuucaucgaggugaagacauguaccuggccaaaaagccacacucugugguccaauggaguucucgaaucagagaugauuauccccaagauauacggcgguccuaucagccagcauaacuaucggccaggcuacuucacacagaccgcggggccguggcaccugggaaaacuugaguuggacuuugaucugugcgaaggcacgacugugguagucgacgagcacugcgggaaucgaggacccucuuuaagaaccacaaccgugacuggcaagauuauccaugaaugguguugcagguccuguacacucccuccacugcgcuuccggggugaggaugggugcugguacggaauggagauuagacccgugaaagaaaaggaggaaaaccuugucaggaguaugguuagcgccggcucuggugagguggacuccuuuucacugggcaucuugugugcuaguauaaugauugaagagguaaugcgcagccgauggucgcggaagaugcucaugaccgggacacuggccguguuccuacugcucgucaugggacaacugacuuggaaugaccuuauccguuugugcaucauggugggcgcaaacgcuuccgauagaauggggaugggaaccacguaucuggccuuaauggcaacauuuaaaaugaggccuauguucgccguuggccuccuguuucgccggcuuaccucuagagaggugcugcuacucacuauuggucugagcuuggucgcuucaguggaacugccaaacaguuuagaggaacucggggacggacuggcgaugggcaucaugaugcuuaagcuguugaccgaguuccagccccaccagcucuggauuacacugcuaucccugacuuuuauaaaaaccacgcuuucucucgauuacgccuggaagacaaccgcaauggcucugagcaucguuuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauuauggccaucggcauagucuccauccugcuaagcucgcugcuuaagaaugacguaccucucgccgggccccugauugcuggaggcauguugaucgcauguuaugugauuucagguucuagugccgauuuaucccuggagaaagcggcugaaguuagcugggagcaagaagccgagcauucugggacgagccacaacauccucguggaaguccaggacgauggaacuaugaagauaaaagacgaggagcgagaugacacccugacaauucuucugaaggcaaccuugcuagccguguccggcguauacccaaugucaaucccugcuacacuguuugugugguauuucuggcagaaaaagaagcagcgcaguggcguccucugggauacucccagcccaccggaaguugagcgggcagugcuggacgaugggaucuacaggauucuucaacgaggauuacugggucguucucaggugggcgucgggguguuccaggacggaguuuuucauaccauguggcacguaacgcgcggcgccgugcucauguaucaggguaaacgguuggaaccuuccugggcgucagucaagaaagaccugauaaguuacgggggaggcuggagauuccaaggcagcuggaauacaggggaggaggugcagguuaucgcuguggaacccggaaagaaccccaagaauguccagacuaugcccgguaccuuuaagacaccugagggcgaagugggggccauugcacucgauuucaagccaggaaccuccggcucucccaucguaaacagggaggguaaaauugucgggcuguacggaaauggcgugguuacuaccucgggcacauaugugagcgccaucgcucaagccaaggcaucacaggaagggccucuuccggagauagaggacgaagucuuuaaaaagcgaaaccugacgaucauggauuugcacccaggauccgguaaaacucggcgcuaccuacccgcuauggugagagaggccauuaagaggaagcugcggacccucaucuuagcgccuacacgaguuguggccagugaaauggcagaggcucugaaaggcaugccaauuagauaucagaccacugccgucaagucugaacauacagggcgcgagaucguggaccuuaugugccacgcuaccuucacgaugaggcugcucagccccguacgugugccuaauuacaacaugauaauuauggaugaggcacauuuuacugacccggccuccaucgccgcucggggauauaucucaacaagaguuggcaugggugaagcggcagccauuuucaugaccgcuacacccccagggucugucgaggccuuuccucagagcaaugcagugauccaagaugaagagagggacauacccgaacgcaguuggaacuccggauacgauuggauuacugacuucccaggcaaaacagugugguuugucccuagcaucaagucuggcaaugauauugccaacuguuugagaaagaacgggaagagaguaauccagcugucacggaagaccuucgacacagaguaucagaaaacuaagaauaacgacugggauuacgugguuacgaccgacauauccgagaugggagcuaauuucagggcggaucgcgugauugacccccguagaugccucaaaccagucauccugaaggaugguccggaacgggugauccuugccggcccuaugcccguuacaguggcaagugcugcccagaggcgcgggcgaauuggaagaaaccaaaauaaagagggcgaccaguacgucuauaugggucagccacuaaacaaugaugaagaccacgcacauuggacugaggccaagaugcuguuggauaacaucaauacccccgaggggauuauaccugcuuuauuugaaccagagcgggaaaagagcgccgcgaucgacggcgaguacaggcugcgcggagaagcaagaaaaacauucguggagcucaugaggcggggcgaucugcccguauggcuuucguauaagguggccucugagggguuucaguacuccgaccgucgcuggugcuucgauggagaacgaaacaaucaaguucuggaggaaaacauggacgucgagauuuggaccaaagaaggugagagaaagaaacucaggccucggugguuggacgcucgcacuuauagcgauccgcuggcccuaagagaguuuaaggaguucgcugcaggcaggcggucagugaguggggaccugauccucgagaucggaaaacuuccacagcaccugacguuacgagcccagaaugcuuuggauaaccuggugaugcuccacaauucugaacagggcgguaaggccuacagacaugcaauggaggaacugcccgacaccauugagacacuuaugcugcucgcguugauagccguccugacugggggcguuaccuuauuuuuccuauccggaaagggccuggggaaaacaagcaucggacuccuuugugugaccgcuucaagugcccuguuguggauggcaagcguagagccucacuggauugcugccuccaucauucuggaauuuuuccucauggugcugcuuauccccgagccagaucgccaaaggacuccucaggacaaccagcucgcauaugucgugauaggucuguuguuuaugauccugacaguugccgcuaacgaaaugggcuuacuagagacgaccaagaaagaucuggggauuggacauguggcggccgagaaucaccaacacgcaacuaugcucgacgucgaucuucggcccgcuucugccuggacacuguacgccguagcaaccaccgugaucacaccaaugaugcgucauacuauugaaaacacgaccgcuaauaucagcuugacagccauagcgaaccaggcugccauucugaugggccucgacaaggguuggccuaucuccaaaauggauauugggguuccgcugcuugcauuaggcugcuacucacaggugaauccccugacucucaccgccgcugucuugaugcugguggcacacuaugccaucauaggaccaggccuacaggcgaaggcuacaagagaggcccaaaagaggaccgcagccgggaucaugaaaaacccuacugucgacggaauuguggcuaucgaucuggaccccguuguguacgacgccaaguucgaaaaacagcucggccagauuaugcuucugaucuuguguacgucucagauacugcucaugcgcacaaccugggcacugugcgagaguauuacuuuagcuaccgguccacuuacaacucugugggaagggucgccuggaaaguuuuggaauaccacaaucgccguaagcauggcgaacaucuuccggggcuccuaucucgccggugcaggccuagcuuucucucugaugaaaucacuagggggaggccgaagagggacgggagcccaaggcgagacccugggugagaaguggaagaggcagcucaaucagcuuagcaaauccgaauuuaacacuuacaagcgcagugggauuauggagguggaucggucugaagcaaaagagggacugaagagaggcgaaacaaccaaacaugcugucagccgugguacugccaaguugaggugguucguugagcggaaucuggugaagcccgagggcaaagucaucgaccucggguguggacgcggcggguggucauauuacugcgccggauuaaagaaagugacagaaguaaagggcuauaccaaaggugggccgggacacgaggaaccaauaccuauggcgacguacggcuggaaccuggugaaacuucauuccggcaaagauguauuuuucaugcccccagagaagugugacacccugcuaugcgauauuggggaaaguagccccaauccuacaaucgaggagggacgaacucucagagugcugaagauggucgaaccgugguugagggguaaccaguuuuguauuaaaauccugaaucccuacaugccaucuguggucgagacccucgaacaaaugcagcggaagcacggcgggaugcuugugcgcaacccucuguccagaaauucaacacacgagauguauuggguuagcugcggaacuggcaacauaguaucggcugugaacaugaccucuaggauguuacugaaucgauucacaauggcacaucggaaacccaccuacgagcgugacgucgauuugggugccgggacuagacacguggcuguugaaccugagguggccaaccucgacaucauuggacagcgcaucgaaaauauuaagaacgagcauaaaaguacguggcacuaugaugaagacaauccauacaagacaugggcauaucacggcuccuacgaggucaagcccagcggcucagccuccucuauggugaacgggguagugaggcugcuaaccaaaccuugggauguuaucccaauggucacucaaauugcuaugaccgacacaacgcccuuuggacagcagcggguguucaaggagaaaguggacaccagaacuccgcgcgcgaagagggguacaacccagaucauggaagucacugccaaauggcuuuggggcuuucugagccgaaauaagaagccucggauauguacaagagaggaguucaccaggaaaguucgcaguaacgcagcuauuggggccguguuuguagaugagaaucaauggaacuccgcaaaggaagccguggaggacgagcguuucugggaucucguccaucgggaaagagagcugcacaaacagggaaagugcgcuacaugcguguauaauaugaugggcaaaagggaaaagaaguugggugaguuugggaaagccaagggaagccgcgcgaucugguacauguggcugggcgcacgauuccucgaguucgaggcccuuggcuuuaugaacgaggaccauugguucucucgggaaaauucacugagugggguugagggagaagguuuacacaaacugggcuacaucuugagagauauuuccaagauaccagggggaaacauguaugcugacgauacugccggcugggacaccaggaucacggaggaugaccuccagaaugaggcaaaaauuaccgaaaucauggagcccgaacaugcucugcuagccacaagcauuuuuaaacuuacuuaccagaacaaagugguccgcgugcaaagaccugcuaagaacgguaccguaauggauguuaucucucggagggaccagcgugggucgggacaggugggcacauauggccugaauacuuucaccaacauggagguccagcucauacgacaaauggaaucagaggggaucuuucugccaagcgaguuggaaacgcccaauuuagccgagcgcgugcuggauuggcucgaaaagcacggagcagagagacuuaaacggauggcgauuuccggugacgacuguguggucaagccgaucgaugacagguucgccacagcucugaccgcccuaaacgauaugggcaaaguucgcaaggacauuccucagugggaacccaguaaaggguggaaugauuggcaacaggugccauuuugcucucaccauuuccaccaacugaucaugaaggacggaagagagauaguagugccuugucggaaccaggaugagcucgucggcagggcacgagugagccagggugcugggugguccuugcgugaaacugccugccugggaaagucauacgcacaaauguggcagcuuauguauuuucauagacgcgaccugcggcucgccgcgaaugcuauuuguagugccguucccguggauugggucccaacaucuaggaccacuuggagcauccacgcacaccaucaguggaugaccacagaggacauguuauccguguggaacagaguauggaucgaagagaaucccuggauggaagauaaaacgcacguuucaagcugggaggaggugccuuaccugggcaagcgcgaagaccaguggugcggcucuuugauugggcugaccgcccgggcuacuugggccacaaacauacaagucgcaaucaaucaggugaggcgacucauuggaaacgagaauuaucuugacuacaugaccuccaugaaaagauucaagaacgaaagugauccagagggugcucugugguga

SEQ ID NO: 13375 - RNA, 9879 nt, Artificial Sequence
  derived and/or modified CDS sequence (opt3) from DENV-1__KJ189326__SS-prME
agcgugaccaugcugcucaugcuucugcccacugcauuggcuuuccacuuaacuacgcgaggaggggaaccucauaugaucgucuccaagcaggaaaggggaaaaucucugcuguuuaagaccucagccgguguuaacaugugcacacucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcacgaucuucauauuacugaugcuugugacuccaucaauggccaugcggugcgucgggaucggaaaccgcgauuuuguggaggguuugagcggcgcgacauggguugacguugugcuggagcacgggaguugugucaccacuauggcaaagaauaaacccacacuagauauugaacuccugaagaccgaggugacgaacccugccauccuuagaaaacugugcauugaagcuaagaucuccaauaccacaacugacucuagguguccaacccagggagaggccacauugguggaagaacaggaugcaaacuucgucugccggcgcacuuuuguugaccgaggcugggguaauggguguggacucuucggcaaaggcagccuguuaaccugcgcuaaguuuaagugcgugacaaaacuggaggggaagauaguacaguacgaaaaccucaaauauuccgugauugucaccgugcacacuggagaucaacaucagguugguaaugagacgacagaacacggcaccaucgccacuauuaccccacaggcgccuacaucagagauccagcuuaccgacuacggggcccugacuuuggacuguaguccaagaacaggacuagauuucaacgaaauggugcugcucacgaugaaggagaaaagcuggcugguccauaagcaaugguuucuugaccugccguugcccuggaccucuggcgcauccacuucacaggagacauggaauaggcaggaucuccuggugaccuucaaaacagcucacgccaagaagcaagaaguaguuguguuagguagccaggagggggcuaugcacacugcccugaccggcgcaacggaaauccagaccaguggaacaacuaccauuuuugccggccaucuaaaaugccggcucaagauggacaaacugacacuuaaggggacuucuuaugucauguguaccggauccuucaaauuggagaaggaaguggcugagacgcagcacgguacaguccuggugcaaguuaaguacgagggcaccgaugcgccuugcaaaauaccauucagcacucaggacgaaaagggggugacacagaacggacgucucaucaccgcaaaucccauuguaacugauaaagagaagccugucaacaucgaaaccgagccacccuuuggcgagucguauauagugguuggugccggggaaaaagcucugaaacuuucuugguucaagaaaggcuccucaauuggaaagauguuugaggccacagcacgcggcgccagaaggauggcuauccugggggacacggccugggauuucggaaguaucgguggcguguuuaccagcgucgggaaauuggugcaucagguauucggaacugcauacggcgugcucuuuuccgguguuucuuggacaaugaagauugggaucggcauucuguuaaccuggcugggacuaaauagccggucaacaagucucuccaugacuuguauagcggucggcauggugacccuguaccuuggggugaugguccaagcugacagcggaugcguuaucaacuggaaaggccgagaauugaagugugguucugggauuuucgugacgaacgaggugcacacauggaccgaacaguauaaguuucaggccgauucaccgaaacgccugagugcagccaucggaaaggcuugggaggagggcguaugcgguaucagaagcgccacuaggcucgaaaauauuauguggaaacagauauccaacgagcugaaucauaucuuacuggaaaacgacaugaaguucaccgucgugguuggcgacgcaaaugggauucuugcucaaggcaagaagaugauccggccucagcccauggagcacaaauacucuuggaagucguggggcaaggccaaaauuaucggggcggauauacagaacacaacuuuuaucauugacggaccagauaccccugaaugucccgacaaucagcgcgccuggaacaucugggagguggaggauuauggcuucgguauuuuuacaacgaauaucugguugaagcucagagacagcuacacccaaaugugcgaucacaggcugauguccgcugcaauaaaagacucaaaggccguccaugcugauaugggguauuggauugaaagugagaaaaacgaaacuuggaagcuagcccgugcaucuuucaucgaggugaagacauguaccuggccaaaaagccacacucugugguccaauggaguucucgaaucagagaugauuauccccaagauauacggcgguccuaucagccagcauaacuaucggccaggcuacuucacacagaccgcggggccguggcaccugggaaaacuugaguuggacuuugaucugugcgaaggcacgacugugguagucgacgagcacugcgggaaucgaggacccucuuuaagaaccacaaccgugacuggcaagauuauccaugaaugguguugcagguccuguacacucccuccacugcgcuuccggggugaggaugggugcugguacggaauggagauuagacccgugaaagaaaaggaggaaaaccuugucaggaguaugguuagcgccggcucuggugagguggacuccuuuucacugggcaucuugugugcuaguauaaugauugaagagguaaugcgcagccgauggucgcggaagaugcucaugaccgggacacuggccguguuccuacugcucgucaugggacaacugacuuggaaugaccuuauccguuugugcaucauggugggcgcaaacgcuuccgauagaauggggaugggaaccacguaucuggccuuaauggcaacauuuaaaaugaggccuauguucgccguuggccuccuguuucgccggcuuaccucuagagaggugcugcuacucacuauuggucugagcuuggucgcuucaguggaacugccaaacaguuuagaggaacucggggacggacuggcgaugggcaucaugaugcuuaagcuguugaccgaguuccagccccaccagcucuggacaacucugcuaucccugaccuuuauuaaaacgacacuuucucucgauuacgccuggaagaccacugcaauggcucugagcauaguuuccuuguucccgcuguguuuaucaacaaccagccagaaaacuacauggcucccugugcugcuuggcaguuuugggugcaagccacugaccauguucuugaucacggaaaauaagauuuggggaaggaaaucuuggccccucaacgaggguaucauggccauuggcaucgucuccauacugcuaagcucgcugcuuaagaaugacguaccucucgccgggccccugaucgcuggaggcauguugauugcauguuaugugaucucagguucuagugccgauuuaucccuggagaaagcggcugaaguuagcugggagcaagaagccgagcauucugggacuagccacaacauucucguggaaguccaggacgauggaaccaugaagaucaaagacgaggagcgagaugacacacugaccauacuucugaaggcaacauugcuagccguguccggcguauacccaaugucaauuccugcuacucuguuugugugguauuucuggcagaaaaagaagcagcgcaguggcguccucugggauacccccagcccaccggaaguugagcgggcagugcuggacgaugggaucuacagaauccuucaaaggggauuacugggucguucucaggugggcgucgggguguuccaggacggaguuuuucauacgauguggcacguaacacgcggcgccgugcucauguaucaggguaaacgguuggaaccuuccugggcgucagucaagaaagaccugauuaguuacgggggaggcuggagauuccaaggccucuggaauacuggggaggaggugcagguuauagcuguggaacccggaaagaaccccaaaaauguccagaccacacccgguaccuuuaagacuccugagggcgaagugggggccaucgcacuggauuucaagccaggaaccagcggcucccccauuguaaacagggaggguaaaaucgucgggcuuuacggaaauggcgugguuacaacgucuggcacuuaugugucggccauugcucaagccaaggcaagccaggaagggccucugccggagaucgaggacgaagucuuuaaaaagcgaaacuugaccauaauggaucuacacccaggaucagguaaaacacggcgcuaccugcccgcuauggugagagaggccaucaagaggaagcuccggaccuuaauucuggcgccuacucgaguuguggccuccgaaauggcagaggcucuuaaaggcaugccaaucagauaucagacaaccgccgucaagagugaacauacggggcgcgagauuguggaccugaugugccacgcuacuuucacaaugaggcucuugucucccguacgugugccuaauuacaacaugaucauaauggaugaggcacauuuuaccgacccggccagcauugccgcucggggauauaucuccaccagaguuggcaugggugaagcggcagccaucuucaugacugcuacacccccagggucagucgaggccuuuccucagucuaaugcagugauucaagaugaagagagggacauccccgaacgcagcuggaacaguggauacgauuggauaaccgacuucccaggcaaaacagugugguuugucccuuccauuaagagcggcaaugauaucgccaacugucugcggaaaaacgggaagagaguaauucagcucucuagaaagacuuucgacacggaguaucagaaaaccaagaauaacgacugggauuacgugguuacaacugacaucucagagaugggagcuaauuucagggcggaucgcgugauagacccccguagaugccugaaaccagucauucuuaaggaugguccggaacgggugauccuagccggcccuaugcccguuaccguggcauccgcugcccagaggcgcgggcgaaucggaagaaaccaaaauaaagagggcgaccaguacgucuauaugggucagccacugaacaaugaugaagaccacgcacauuggacagaggccaagauguuguuagauaacauuaauacccccgaggggaucauuccugcucuguuugaaccagagcgggaaaagagugccgcgauagacggcgaguacaggcuccgcggagaagcaagaaaaacuuucguggagcugaugaggcggggcgaucuucccguauggcugagcuauaagguggccucggagggguuucaguacucugaccgucgcuggugcuucgauggagaacgaaacaaucaaguucucgaggaaaacauggacgucgagaucuggacgaaagaaggugagagaaagaaauugaggccucgguggcuggacgcucgcaccuauuccgauccgcuagcccugagagaguuuaaggaguucgcugcaggcaggcggagcgugucaggggaccucauucuugagaucggaaaacugccacagcacuuaacauugcgagcccagaaugcucuggauaaccucgugaugcugcacaauagugaacagggcgguaaggccuacagacaugcaauggaggaacuucccgacacuaucgagacccugaugcucuuggcgcugauugccgucuuaacagggggcguuacccuauuuuuccugucuggaaagggccucgggaaaacuuccauaggacuucugugugugacagcuagcucagccuugcuguggauggcaaguguagagccucacuggaucgcugccagcauuauccucgaauuuuuccugauggugcuucucauucccgagccagaucgccaaaggacgccucaggacaaccagcuggcauaugucgugaucgguuugcuguuuaugauauuaaccguugccgcuaacgaaaugggccuacuggagacuacaaagaaagaucucgggaucggacauguggcggccgagaaucaccaacacgcaaccaugcuugacgucgaucugcggcccgcuuccgccuggaccuuguacgccguagcaacaacugugauuacgccaaugaugcgucauaccaucgaaaacacaacugcuaauauuucucugaccgccaucgcgaaccaggcugccauacucaugggccuggacaaggguuggccuauuagcaaaauggauaucgggguuccgcuuuuagcacugggcugcuacucccaggugaauccccucacauugaccgccgcuguccugaugcuaguggcacacuaugccauuaucggaccaggccugcaggcgaaggcuacuagagaggcccaaaagaggacggcagccgggauaaugaaaaacccuacagucgacggaaucguggcuauugaucucgaccccguuguguacgacgccaaguucgaaaaacagcuuggccagaucaugcuguugauucuguguaccucacagauccuccugaugcgcacuaccugggcauuaugcgagucuauaacacuugcuacugguccacugaccacacucugggaagggaguccuggaaaguuuuggaauacgaccauugccguaucgauggcgaacaucuuccggggcagcuaucuagccggugcaggccuggcuuucuccuugaugaaaucucuagggggaggccgaagagggacuggagcccaaggcgagacacucggugagaaguggaagaggcagcuuaaucagcugucaaaaagcgaauuuaacaccuacaagcgcuccgggaucauggagguggaucggagugaagcaaaagagggauugaagagaggcgaaacuacaaaacaugcugucucucgugguaccgccaagcugaggugguucguugagcggaaucucgugaagcccgagggcaaagucauugacuuaggguguggacgcggcggguggagcuauuacugcgccggacugaagaaagugacggaaguaaagggcuauaccaaaggugggccgggacacgaggaaccaaucccuauggcgacauacggcuggaaccuugugaagcugcauucaggcaaagauguauuuuucaugcccccagagaagugugacacucuacucugcgauauaggggaauccagucccaauccuaccauugaggagggacgaacacugagaguguugaagauggucgaaccguggcugagggguaaccaguuuuguaucaaaauucucaaucccuacaugccaagcguggucgagacucuugaacaaaugcagcggaagcacggcgggaugcuggugcgcaacccuuuaucuagaaauuccacccacgagauguauuggguuucaugcggaacaggcaacaucguaagcgcugugaacaugaccucgaggaugcuguugaaucgauucacuauggcacaucggaaacccacguacgagcgugacgucgaucucggugccgggacaagacacguggcuguugaaccugagguggccaaccuggacauaaucggacagcgcauugaaaauaucaagaacgagcauaaaucuaccuggcacuaugaugaagacaauccauacaagacuugggcauaucacggcaguuacgaggucaagcccuccggcagcgccucauccauggugaacgggguagugaggcuacuuaccaaaccuugggauguuauuccaauggucacacaaaucgcuaugacggacaccacucccuuuggacagcagcggguguucaaggagaaaguggacacaagaaccccgcgcgcgaagagggguacuacacagauuauggaagucaccgccaaauggcuguggggcuuucucucucgaaauaagaagccucggaucuguacaagagaggaguucacuaggaaaguucgcagcaacgcagcuauaggggccguguuuguagaugagaaucaauggaacagugcaaaggaagccguggaggacgagcguuucugggaucugguccaucgggaaagagaguugcacaaacagggaaagugcgcuaccugcguguauaauaugaugggcaaaagggaaaagaagcugggugaguuugggaaagccaagggaucccgcgcgauuugguacauguggcucggcgcacgauuccuugaguucgaggcccugggcuuuaugaacgaggaccauugguucagccgggaaaauucuuuaucagggguugagggagaaggucugcacaaauugggcuacauccucagagauaucaguaagauuccagggggaaacauguaugcugacgauacggccggcugggacaccaggauaacagaggaugaccugcagaaugaggcaaaaaucacugaaauuauggagcccgaacaugcucuacuugccaccuccaucuuuaagcugacauaccagaacaaagugguccgcgugcaaagaccugcuaagaacgguacuguaauggauguuauuagccggagggaccagcgugggucuggacaggugggcaccuauggccucaauacguucacaaacauggagguccagcugauccgacaaauggaaucggaggggauauuuuugccaucagaguuagaaacccccaaucuggccgagcgcgugcucgauuggcuugaaaagcacggagcagagagacugaaacggauggcgaucagcggugacgacuguguggucaagccgauugaugacagguucgccacugcucuaacagcccugaacgauaugggcaaaguucgcaaggacaucccucagugggaacccuccaaaggguggaaugauuggcaacaggugccauuuugcagucaccauuuccaccaacucauuaugaaggacggaagagagaucguagugccuugucggaaccaggaugaguuggucggcagggcacgagugucucagggugcuggguggagccugcgugaaaccgccugccuuggaaaguccuacgcacaaauguggcagcugauguauuuucauagacgcgaccuccgguuagccgcgaaugcuauauguucagccguucccguggauugggucccaacaaguaggaccacauggucuauucacgcacaccaucaguggaugacgaccgaggacaugcugagcguguggaacagaguauggaucgaagagaaucccuggauggaagauaaaacucacguuuccucaugggaggaggugccuuacuugggcaagcgcgaagaccaguggugcggcagccugaucgggcucacagcccgggcuaccugggccacuaacauucaagucgcaauaaaucaggugaggcgacuuaucggaaacgagaauuaucuggacuacaugacaucuaugaaaagauucaagaacgaauccgauccagagggugcucuaugguga

SEQ ID NO: 13376 - RNA, 9879 nt, Artificial Sequence
  derived and/or modified CDS sequence (opt3) from DENV-1__KJ189327__SS-prME
agcgugaccaugcugcucaugcuucugccaacagcauuggcuuuccacuuaacuacgagaggaggggagccucauaugauagucuccaagcaggaaaggggaaaaucucuguuguuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgagaagcgaagcguggcccuggcaccccaugucggcuugggucucgaaacucguaccgagacauggauguccucugaaggggccuggaaacagauccagagaguggagacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgacuuuguggaggguuugagcggcgcgacuuggguagauguugugcuggaacacgggaguugugucacaaccauggcaaagaauaaacccacucuagacaucgagcuccugaagacagaagugaccaacccugccauucuuagaaaacugugcaucgaggcuaagauauccaauacgaccacagauucuagguguccaacucagggagaagccaccuugguggaggagcaggacgcaaacuucgucugccggcgcacauuuguugaucgaggcugggguaauggguguggacucuucggcaaaggcagccuguuaacuugcgcuaaguuuaagugcgugaccaaacuggaagggaagauuguacaguacgagaaccucaaauauuccgugaucgucacagugcacaccggagaccaacaucagguugguaaugaaacuacggagcacggcacaauugccaccaucacuccccaggcgccuaccucagaaauccagcuuacagauuacggggcccugaccuuggacuguaguccaagaacuggacuagacuucaacgagauggugcugcucacaaugaaggagaaaagcuggcugguccauaagcaaugguuucuugaucugccguugcccuggacgucuggcgcauccaccucacaggaaacuuggaauaggcaggaccuccuggugacauucaaaaccgcucacgccaagaagcaagagguaguuguguuagguagccaggaaggggcuaugcacacagcccugacuggcgcaaccgagauucagacgaguggaaccacaacuauauuugccggccaucuaaaaugccggcucaagauggauaaacugacccuuaaggggacaucuuaugucauguguacuggauccuucaaauuggaaaaggagguggcugagacccagcacgguacgguccuggugcaaguuaaguacgaaggcacagacgcgccuugcaaaaucccauucagcacccaggaugagaagggggugacucagaacggacgucucauuacagcaaaucccaucguaaccgacaaagaaaagccugucaacauagagacugagccacccuuuggcgaaucguauauugugguuggugccggggagaaagcucugaaacuuucuugguucaagaaaggcuccucaaucggaaagauguuugaagccaccgcacgcggcgccagaaggauggcuauccugggggauacagccugggacuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugauagcggaugcguuauuaacuggaaaggccgagaguugaagugugguucugggaucuucgugaccaacgaagugcacacguggacagagcaguauaaguuucaggccgacucaccgaaacgccugagugcagccaucggaaaggcuugggaggaaggcguaugcgguauuagaagcgccaccaggcucgagaauauaauguggaaacagaucuccaacgaacugaaucauauuuuacuggagaacgauaugaaguucacugucgugguuggcgacgcaaaugggauccuugcucaaggcaagaagaugauucggccucagcccauggaacacaaauacucuuggaagucguggggcaaggccaaaaucauaggggcggacacccagaacacaacuuuuaucauugauggaccagacaccccugagugucccgauaaucagcgcgccuggaacaucugggagguggaagacuauggcuucgguauuuuuacaacgaauaucugguugaagcucagagauagcuacacccaaaugugcgaccacaggcugauguccgcugcaauaaaagauucaaaggccguccaugcugacaugggguauuggauugagagugagaagaacgagacuuggaagcuagcccgugcaucuuucaucgaagugaagacauguaccuggccaaaaagccacacucugugguccaauggaguucucgagucagagaugauuauccccaagauauacggcgguccuaucagccagcauaacuaucggccaggcuacuucacacagaccgcggggccguggcaccugggaaaacuugaauuggauuuugaccugugcgagggcacgacugugguagucgaugaacacugcgggaaucgaggacccucuuuaagaaccacaaccgugacuggcaagauuauccaugagugguguugcagguccuguacacucccuccacugcgcuuccggggugaggacgggugcugguacggaauggaaauuagacccgugaaagagaaggaagagaaccuugucaggaguaugguuagcgccggcucuggugaaguggauuccuuuucacugggcaucuugugugcuaguauaaugauugaggagguaaugcgcagccgauggucgcggaagaugcucaugaccgggacacuggccguguuccuacugcucaucaugggacaacugacuuggaaugaccuuauccguuugugcauuauggucggcgcaaacgcuuccgacagaauggggaugggaaccacguaucuggccuuaauggcaacauuuaaaaugaggccuauguucgccgugggccuccuguuucgccggcuuaccucuagagaaguucugcuacucacuaucggucugagcuugguggcuucagucgagcugccaaacaguuuagaggaacucggggauggacuggcgaugggcauuaugaugcuuaagcuguugaccgaguuccagccccaccagcucuggacaacucugcuaucccugaccuuuauaaaaacgacacuuucucucgacuacgccuggaagaccacugcaauggcucugagcaucguguccuuguucccgcuguguuuaucaacaaccagccagaaaacuacauggcucccuguucugcuuggcaguuuugggugcaagccacugaccauguucuugauuacggagaauaagaucuggggaaggaaaucuuggccccucaacgaggguauuauggccaucggcauaguguccauccugcuaagcucgcugcuuaagaaugaugucccucucgccgggccccugauugcuggaggcauguugaucgcauguuauguaauuucagguucuagugccgacuuaucccuggaaaaagcggcugaggugagcugggaacaagaggccgaacauucugggacuagccacaacauccucguugaggugcaggaugacggaaccaugaagauaaaagaugaggaacgagacgauacacugaccauucuucugaaggcaacauugcuagccgucuccggcguguacccaaugucaaucccugcuacucuguuuguaugguauuucuggcagaaaaagaagcagcgcaguggcgugcucugggacacccccagcccaccggaggucgaacgggcaguucuggaugacgggaucuacaggauucuucaacgaggauuacugggucguucucaggugggcgugggggucuuccaggauggaguguuucauacgauguggcacguuacacgcggcgccguacucauguaucaggguaaacgguuggagccuuccugggcgucagugaagaaagaccugauaaguuacgggggaggcuggagauuccaaggcagcuggaauacuggggaggaaguccaggugaucgcuguugagcccggaaagaaccccaagaaugugcagaccacacccgguaccuuuaagacuccugaaggcgaggucggggccauugcacucgacuucaagccaggaaccuccggcucucccaucgugaacagggaagguaaaauuguagggcuguacggaaauggcgucgugacaacgucgggcacuuauguuagcgccaucgcucaagccaaggcaucacaggaggggccucuuccggagauagaagaugagguguuuaaaaagcgaaaccugaccaucauggacuugcacccaggauccgguaaaacacggcgcuaccuacccgcuauugucagagaagccaucaagaggaagcugcggacccucauuuuagcgccuacucgagugguugccagugagauggcagaagcucugaaaggcaugccaaucagauaucagacaaccgccgugaagucugagcauacggggcgcgagauagucgaucuuaugugccacgcuacuuucacaaugaggcugcucagccccgugcguguaccuaauuacaacaugauuaucauggacgaagcacauuuuaccgauccggccuccaucgccgcucggggauauauuucaaccagagugggcaugggugaggcggcagccaucuucaugacugcuacacccccagggucuguugaagccuuuccucagagcaaugcagucauacaagacgaggaaagggauauucccgagcgcaguuggaacuccggauacgacuggaucaccgauuucccaggcaaaacagugugguuugugccuagcauuaagucuggcaaugacaucgccaacuguuugagaaagaacgggaaaagagucauacagcugucacggaagacuuucgauacggaguaucagaaaaccaagaauaacgacugggacuacguagugacaacugauauuuccgaaaugggagcuaauuucagggcggaccgcguuaucgauccccguagaugccucaaaccagugauccugaaggacgguccggagcgggucauucuugccggcccuaugcccgugaccguugcaagugcugcccagaggcgcgggcgaaucggaagaaaccaaaauaaagaaggcgaucaguacguguauaugggucagccacuaaacaaugacgaggaucacgcacauuggacagaggccaagaugcuguuggacaacauuaauacccccgaagggauaaucccugcuuuauuugagccagaacgggaaaagagcgccgcgauugauggcgaauacaggcugcgcggagaggcaagaaaaacuuucgucgagcucaugaggcggggcgaccugcccguguggcuuucguauaagguagccucugaaggguuucaguacuccgaucgucgcuggugcuucgacggagagcgaaacaaucaagugcuggaagagaacauggauguugaaaucuggacgaaagagggugagagaaagaaacucaggccucggugguuggacgcucgcaccuauagcgacccgcuggcccuaagagaauuuaaggaguucgcugcaggcaggcggucagucaguggggaucugauccucgaaauuggaaaacuuccacagcaccugacauuacgagcccagaaugcuuuggacaaccuggugaugcuccacaauucugagcagggcgguaaggccuacagacaugcaauggaagaacugcccgauacuauagagacccuuaugcugcucgcguugaucgccgugcugacagggggcgucaccuuauuuuuccuauccggaaagggccuggggaaaacuagcauuggacuccuuuguguuacagcuucaagugcccuguuguggauggcaagcguggaaccucacuggaucgcugccuccauuauccuggaguuuuuccucaugguacugcuuauacccgaaccagaccgccaaaggacgccucaggauaaccagcucgcauauguggucaucggucuguuguuuaugauucugaccguggccgcuaacgagaugggcuuacuagagacuacaaagaaagaccuggggaucggacauguugcggccgaaaaucaccaacacgcaaccaugcucgauguggaccuucggcccgcuucugccuggacccuguacgccgucgcaacaacuguaauuacgccaaugaugcgucauaccaucgagaacacaacugcuaauaucagcuugaccgccauugcgaaccaggcugccauccugaugggccucgauaaggguuggccuauuuccaaaauggacaucggggugccgcugcuugcauuaggcugcuacucacagguuaauccccugacacucaccgccgcuguguugaugcuggucgcacacuaugccauaaucggaccaggccuacaggcgaaggcuacuagagaagcccaaaagaggacggcagccgggauuaugaaaaacccuacaguggauggaaucgucgcuauugaccuggaucccgugguuuacgacgccaaguucgagaaacagcucggccagaucaugcuucugauauuguguaccucucagauucugcucaugcgcacuaccugggcacugugcgaaaguaucacauuagcuacugguccacuuaccacacugugggaggggucgccuggaaaguuuuggaauacgaccaucgccgugagcauggcgaacauuuuccggggcuccuaucucgccggugcaggccuagcuuucucucugaugaaaucacuagggggaggccgaagagggacuggagcccaaggcgagacacugggugaaaaguggaagaggcagcucaaucagcuuagcaaauccgaguuuaacaccuacaagcgcagugggaucauggaaguagaccggucugaggcaaaagaaggacugaagagaggcgagacuacaaaacaugcugugagccgugguaccgccaaguugaggugguucgucgagcggaaucugguuaagcccgaaggcaaagugauagaucucggguguggacgcggcggguggucauauuacugcgccggauuaaagaaagucacggaggugaagggcuauaccaaaggugggccgggacacgaggaaccaauuccuauggcgacauacggcuggaaccugguaaaacuucauuccggcaaagacguguuuuucaugcccccagaaaagugugauacucugcuaugcgacaucggggagaguagccccaauccuaccauugaggaaggacgaacacucagaguucugaagaugguggagccgugguugagggguaaccaguuuuguaucaaaauacugaaucccuacaugccaucugucguggaaacucucgagcaaaugcagcggaagcacggcgggaugcuuguccgcaacccucuguccagaaauucaacccacgagauguauugggugagcugcggaacaggcaacaucguuucggcuguaaacaugaccucuaggauguuacugaaucgauucacuauggcacaucggaaacccacguuugaacgugauguggacuugggugccgggacaagacacgucgcuguggagccugaaguugccaaccucgauauuaucggacagcgcauugagaauaucaagaacgaacauaaaaguaccuggcacuacgacgaggauaauccauauaagacuugggcauaccacggcuccuaugaggugaagcccagcggcucagccuccucuauggucaacggggugguaaggcugcuaaccaaaccuugggacgugauuccaaugguuacacaaaucgcuaugacggauaccacucccuucggacagcagcgggucuuuaaggaaaaaguggacacaagaaccccgcgcgcgaagagggguacuacacagauaauggaggugaccgccaaauggcuuuggggcuuccugagccgaaauaagaagccucggauuuguacaagagaagaguuuacuaggaaaguccgcaguaacgcagcuaucggggccguuuucguggacgaaaaucaauggaacuccgcaaaggaggccguagaggaugaacguuuuugggaccucgugcaucgggagagagaacugcacaaacagggaaagugcgcuaccugcgucuacaauaugaugggcaaaagggagaagaaguugggugaguucgggaaagccaagggaagccgcgcgaucugguauauguggcugggcgcacgauuccucgaguuugaggcccuuggcuucaugaacgaagaucauugguuuucucgggaaaauucacugagugggguggaaggagaggguuuacacaaacugggcuacauuuugagagacauauccaagaucccagggggaaacauguacgcugaugacacggccggcugggauaccaggauuacagaggacgaucuccagaaugaagcaaaaaucacugacauuauggagcccgaacaugcucugcuagccaccagcaucuucaaacuuacauaucagaacaaaguugugcgcguccaaagaccugcuaagaacgguacugugauggauguaauaucucggagggaccagcgugggucgggacagguuggcaccuacggccugaauacguuuacaaacauggaggugcagcucauccgacaaauggaaucagaggggauuuuccugccaagcgaguuggaaacccccaauuuagccgagcgcguccuggauuggcucgaaaagcacggagcagagagacuuaaacggauggcgaucuccggugacgacuguguggugaagccgauugaugacagguuugccacugcucugacagcccuaaacgauaugggcaaaguccgcaaggacaucccucagugggaacccaguaaaggguggaaugauuggcagcagguuccauucugcucucaccauuuucaccaacugauaaugaaggacggaagagagauugugguaccuugucggaaccaggaugagcucgugggcagggcacgagucagccagggugcugggugguccuugcgugaaaccgccugccugggaaagucauaugcacaaauguggcagcuuauguacuuccauagacgcgaccugcggcucgccgcgaaugcuaucuguagugccgugcccguugauugggugccaacuucuaggaccacauggagcauccacgcacaccaucaguggaugacgaccgaggacauguuauccgucuggaacagaguguggauugaagagaaucccuggauggaagauaaaacucacguaucaagcugggaggagguuccuuaucugggcaagcgcgaagaccaguggugcggcucuuugauagggcugacagcccgggcuaccugggccacuaacauccaaguggcaauuaaucaggucaggcgacucaucggaaacgagaauuaccuugacuauaugacauccaugaaaagauuuaagaacgaaagugauccagagggugcucugugguga

SEQ ID NO: 13377 - RNA, 9879 nt, Artificial Sequence
  derived and/or modified CDS sequence (opt3) from DENV-1__KJ189328__SS-prME
agcgugaccaugcugcucaugcuucugcccacagcauuggcuuuccacuuaacuacgagaggaggggagccucauaugaucgucuccaagcaggaaagaggaaaaucucuguuauuuaagaccucagccgguguuaauaugugcacacucauugccauggaccugggagagcuuugugaagauacuaugaccuacaaaugcccacagauaacagaggcggaaccggacgauguggacuguuggugcaaugcuaccgauacuuggguaacauaugggaccuguagucagacgggagagcaccggcgcgagaagcgaagcguggcccuggcaccccaugucggcuugggucucgaaacucguaccgagacauggauguccucugaaggggccuggaaacagauccagagaguggagacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgacuuuguggaggguuugagcggcgcgacuuggguugauguugugcuggaacacgggaguugugucacaaccauggcaaagaauaaacccacuuuggacaucgagcuccugaagacagaagugaccaacccugccauucuuagaaaacugugcaucgaggcuaagauauccaauacgaccacagauucuagguguccaacucagggagaagccaccuugguggaggagcaggacgcaaacuucgucugccggcgcacauuuguugaucgaggcugggguaauggguguggacucuucggcaaaggcagccuguuaacuugcgcuaaguuuaagugcgugaccaaacuggaagggaagauuguacaguacgagaaccucaaauauuccgugaucgucacagugcacaccggagaccaacaucagguugguaaugaaacuacggagcacggcacaauugccaccaucacuccccaggcgccuaccucagaaauccagcuuacagauuacggggcccugaccuuggacuguaguccaagaacuggacuagacuucaacgagauggugcugcucacaaugaaggagaaaagcuggcugguccauaagcaaugguuucuugaucugccguugcccuggacgucuggcgcauccaccucacaggaaacuuggaauaggcaggaccuccuggugacauucaaaaccgcucacgccaagaagcaagagguaguuguguuagguagccaggaaggggcuaugcacacagcccugacuggcgcaaccgagauucagacgaguggaaccacaacuauauuugccggccaucuaaaaugccggcucaagauggauaaacugacccuuaaggggacaucuuaugucauguguacuggauccuucaaauuggaaaaggagguggcugagacccagcacgguacgguccuggugcaaguuaaguacgaaggcacagacgcgccuugcaaaaucccauucagcacccaggaugagaagggggugacucagaacggacgucucauuacagcaaaucccaucguaaccgacaaagaaaagccugucaacauagagacugagccacccuuuggcgaaucguauauugugguuggugccggggagaaagcucugaaacuuucuugguucaagaaaggcuccucaaucggaaagauguuugaagccaccgcacgcggcgccagaaggauggcuauccugggggauacagccugggacuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugauagcggaugcguuauuaacuggaaaggccgagaguugaagugugguucugggaucuucgugaccaacgaagugcacacguggacagagcaguauaaguuucaggccgacucaccgaaacgccugagugcagccaucggaaaggcuugggaggaaggcguaugcgguauuagaagcgccaccaggcucgagaauauaauguggaaacagaucuccaacgaacugaaucauauuuuacuggagaacgauaugaaguucacugucgugguuggcgacgcaaaugggauccuugcucaaggcaagaagaugauucggccucagcccauggaacacaaauacucuuggaagucguggggcaaggccaaaaucauaggggcggacauccagaacaccacauuuauuaucgauggaccagacacuccugagugucccgauaaucagcgcgccuggaacauuugggagguggaagacuauggcuucgguaucuuuaccacaaauauaugguugaagcucagagauagcuacacgcaaaugugcgaccacaggcugauguccgcugcaauuaaagauucaaaggccguccaugcugacaugggguauuggaucgagagugagaagaaugagaccuggaagcuagcccgugcaucuuucauugaagugaagacuuguacauggccaaaaagccacacccugugguccaauggaguucucgagucagagaugaucauacccaagaucuacggcgguccuauuagccagcauaacuaucggccaggcuacuucacucagacagcggggccguggcaccugggaaaacuugaauuggauuuugaccugugcgagggcaccacggugguagucgaugaacacugcgggaaucgaggacccucuuuaagaacuaccacagugaccggcaagaucauucaugagugguguugcagguccuguacucucccuccacugcgcuuccggggugaggacgggugcugguacggaauggaaaucagacccgugaaagagaaggaagagaaccuugucaggaguaugguuagcgccggcucuggugaaguggauuccuuuucacugggcauauuguguguaaguauuaugaucgaggaggugaugcgcagccgauggucgcggaagaugcucaugacagggacccuggcugucuuccuacugcucaucaugggacaacugacauggaaagaccuuauucguuugugcaucauggugggcgccaaugcauccgacagaauggggaugggaacuaccuaucuggcuuuaauggccacguuuaagaugaggccuauguucgcaguuggccuccuguuucgccggcuuacaucuagagaagugcugcuacucaccauuggucugagcuuggucgccucaguggagcugccaaacaguuuagaagaacucggggauggacuggcuaugggcauaaugaugcuuaaacuguugacugaguuccacccccaucagcucuggaccacacugcuaucccugacuuuuaucaagaccacgcuuucucucgacuacgcguggaaaacaaccgccauggcacugagcauuguuuccuuguucccgcuguguuuaucaacuacaagccagaagaccacuuggcucccugugcugcuuggcaguuuugggugcaagccacugacaauguucuugaucaccgagaacaaaauuuggggaaggaagucuuggccccucaaugaggguaucauggcuauaggcaucgucuccauucugcuaagcucgcugcuuaaaaacgauguaccucucgccgggccccugaucgccggaggcauguugauugcuuguuaugugaucucagguucuagugcagacuuaucccuggaaaaggccgcggagguuagcugggaacaggaggcugaacacucugggacgagccauaauauacucguggagguccaagaugacggaacuaugaaaauuaaggaugaggaacgagacgauacccugacaauccuucugaaagccaccuugcuagcaguguccggcguauacccaaugucaaucccugccacacuguuugugugguauuucuggcagaagaagaaacagcgcaguggcguccucugggacacucccagcccaccggagguugaacgggcugugcuggaugacgggauuuacagaauacuucagaggggauuacugggucguucucaagugggcgucgggguguuccaggauggaguuuuucacaccauguggcacguaacgcgcggcgcagugcucauguaucaggguaagcgguuggagccuuccugggccucagucaaaaaggaccugaucaguuacgggggaggcuggagauuccagggcagcuggaacacaggggaggaagugcaaguuauugcgguggagcccggcaaaaauccaaagaacguccagacuacccccgguacauuuaagaccccugaaggcgaggugggggcuaucgcccucgacuucaaaccaggaacuuccggcucucccauuguaaauagggaagguaagaucgucgggcuguacggaaacggcgugguuaccacaucgggcacguaugugagcgcaauagcccaggcuaaagccucacaagaggggccucuuccggagaucgaagaugaggucuuuaagaaacgaaaucugacuauuauggacuugcauccaggauccgguaagacccggcgcuaccuacccgcaaucgugagagaagcuauuaagaggaaacugcggacacucaucuuagccccuacccgaguuguggcgagugagauggccgaagcacugaagggcaugccaauaagauaucagacuacagcugucaaaucugagcacaccgggcgcgagauuguggaucuuaugugccaugccacguucacuaugaggcugcucagccccguacgugugccuaacuacaauaugaucaucauggacgaagcucacuuuacagauccggcauccauugccgcccggggauauaucucaaccagaguuggcaugggugaggcugcggcaauauucaugaccgccacucccccagggucugucgaggcuuuuccucagagcaacgccgugauucaggacgaagaaagggauauccccgagcgcaguuggaacuccggauacgacuggauuacagauuucccaggcaagaccgugugguuugucccuagcaucaaaucuggcaacgacauagcaaauuguuugcgaaagaacgggaagagaguaauucaacugucacggaaaacauucgauacugaguaucagaagacgaaaaacaaugacugggacuacgugguuaccacagauaucuccgaaaugggagccaacuucagggcugaccgcgugaucgauccccguagaugccucaagccagucauucugaaagacgguccggagcgggugauccuugcgggcccuaugcccguuacuguggccagugcagcucagaggcgcgggcgaauuggaagaaaucagaacaaggaaggcgaucaauacgucuauaugggucagccacuaaauaacgacgaggaucaugcccacuggaccgaggcaaagaugcuguuggacaauauaaacacacccgaagggaucauuccugccuuauuugagccagaacgggagaaaagcgcugccaucgauggcgaauacaggcugcgcggagaggcgagaaagaccuucguggagcucaugaggcggggcgaccugcccguauggcuuucguauaaaguggcaucugaaggguuucaguacuccgaucgucgcuggugcuucgacggagagcgaaauaaccagguucuggaagagaauauggaugucgaaaucuggacuaaggagggugagaggaaaaagcucaggccucggugguuggacgcccgcacguauagcgacccgcuggcucuaagagaauuuaaagaguucgccgcuggcaggcggucagugaguggggaucugauucucgaaauaggaaaacuuccacaacaccugaccuuacgagcacagaacgccuuggacaaucuggugaugcuccauaacucugagcagggcgguaaggcuuacagacacgccaucgaagaacugcccgauacaauugagacucuuaugcugcucgcauugaucgcgguccugaccgggggcguuacauuauuuuuccuauccggaaaaggccuggggaagaccagcauuggacuccuuugugugacugccucaagugcucuguuguggauggccagcguagaaccucauuggaucgcagcuuccauaauccuggaguuuuuccucauggugcugcuuauucccgaaccagaccgccagaggacaccucaagauaaucagcucgccuaugucgugaucggucuguuguuuaugauucugacgguugcagccaacgagaugggcuuacuagagaccacuaaaaaggaccuggggaucggacacguggcugcggaaaaccaccagcaugccacaaugcucgaugucgaccuucggcccgcaucugcuuggacccuguacgccguagccaccacagugauaacuccaaugaugcgucacacgauugagaauaccacagcaaacaucagcuugacugcuauugccaaucaagcggcuauccugaugggccucgauaaagguuggccuauauccaagauggacaucgggguuccgcugcuugccuuaggcugcuacucacaggugaacccccugacccucacagcagccgucuugaugcugguggcucauuaugcaauuaucggaccaggccuacaggccaaggcgaccagagaagcucagaaaaggacugccgcagggauuaugaagaauccuacggucgauggaaucguggccauagaccuggaucccguuguguacgacgcuaaauucgagaagcaacucggccagauuaugcuucugaucuuguguacaucucagauccugcucaugcgcaccacuugggcccugugcgaaaguauuaccuuagcaacagguccacuuacuacccugugggaggggucgccuggaaaauuuuggaacacaacgaucgcuguaagcauggccaauauauuccggggcuccuaucucgcgggugccggccuagcauucucucugaugaagucacuagggggaggccgaagagggaccggagcucagggcgagacucugggugaaaaguggaaaaggcaacucaaccagcuuagcaaguccgaguuuaauacauacaaacgcagugggauuauggaaguggaccggucugaggccaaggaaggacugaaaagaggcgagaccacuaagcacgcagucagccgugguacagcuaaguugaggugguucguugagcggaaccuggugaaacccgaaggcaaggucaucgaucucggguguggacgcggcggguggucauauuacugcgccggacugaaaaaggugaccgagguaaaaggcuauacgaagggugggccgggacaugaggaaccaauuccuauggccaccuacggcuggaaucuagugaaacuucacuccggcaaggacguauuuuucaugcccccagaaaagugugauacacugcuaugcgacaucggggagaguagccccaacccuacuauagaggaaggacgaacccucagagugcugaaaauggucgagccgugguugagggguaaucaguuuuguaucaagauucugaaccccuacaugccaucuguggucgaaacacucgagcagaugcaacggaaacacggcgggaugcuugugcgcaauccucuguccagaaacucaacucaugagauguauuggguuagcugcggaaccggcaauaucguaucggcggugaacaugacaucuaggauguuacugaaccgauucaccauggcucaccggaagcccacuuacgaacgugaugucgacuugggugcagggacgagacauguggccguugagccugaaguggcuaaucucgauauuaucggacagcgcauugagaacaucaaaaaugaacacaagaguacauggcacuaugacgaggauaacccauacaagaccugggccuaucauggcuccuacgaggucaaacccagcggcucagcauccucuauggugaaugggguagugaggcugcuaacuaagccuugggacguuauaccaauggucacccagauugccaugacagauacgacccccuuuggacaacagcggguguucaaagaaaagguggacacuagaacaccgcgcgcuaaaagggguaccacucagaucauggaggucacagcgaaguggcuuuggggcuuucugagccgaaacaagaaaccucggaucuguaccagagaagaguucacaaggaagguucgcaguaaugccgcaauuggggcuguguuuguagacgaaaaccaguggaacuccgccaaagaggcaguggaggaugaacguuucugggaccucguccaccgggagagagaacugcauaagcaaggaaaaugcgccacuugcguguauaacaugaugggcaagagggagaagaaauugggugaauuugggaaggcuaaaggaagccgcgccauaugguacauguggcugggcgcgcgauuccucgaguucgaggcacuuggcuuuaugaaugaagaucacugguucucucgggagaacucacugagugggguugaaggagaggguuuacauaagcugggcuacaucuugagagacauuuccaaaaucccagggggaaauauguaugccgaugacaccgcuggcugggauacgaggauuaccgaggacgaucuccagaacgaagccaagaucacagacauaauggagcccgaacacgcacugcuagcuacuagcaucuuuaaacuuaccuaccagaauaaggugguccgcgugcagagaccugccaagaacgguacaguaauggauguuauuucucggagggaccaacgugggucgggacaggugggcacuuauggccugaacaccuucacgaauauggagguccagcucauccgacagauggaaucagaggggauuuuucugccaagcgaguuggaaacacccaacuuagcugagcgcgugcuggauuggcucgaaaaacacggagccgagagacuuaagcggauggcaaucuccggugacgacuguguggucaaaccgauagaugacagguucgcgaccgcccugacugcucuaaaugauaugggcaagguucgcaaagacauuccucaaugggaacccaguaagggguggaacgauuggcaacaggugccauuuugcucucaucacuuccaucagcugaucaugaaggacggaagagagaucguagugccuugucggaaucaagaugagcucgucggcagggcccgagugagccagggugcagggugguccuugaaagaaacagcuugccugggaaagucauacgcccagauguggcaacuuauguauuuucaccguagagaccugcgccucgcagccaacgcgauuuguagugcuguucccguggauugggucccaaccucucggacuaccuggagcauacacgcccaucaccaguggaugacaacggaggacauguuauccguguggaauaggguauggaucgaagagaaccccuggauggaagauaaaacccauguuucaagcugggaggaggugccuuaccugggcaagagagaagaccaguggugcggcucuuugauugggcugacugcacgcgccacaugggcuaccaauauccaggucgccauuaaccaagugcggaggcucaucggaaaugagaacuaucuugacuacaugacuuccaugaaacgauucaagaaugaaagugauccagagggugcacugugguga

SEQ ID NO: 13378 - RNA, 9879 nt, Artificial Sequence
  derived and/or modified CDS sequence (opt3) from DENV-1__KJ189329__SS-prME
agcgugaccaugcugcucaugcuucugcccacugcauuggcuuuccacuuaacuacgagaggaggggaaccucauaugaucgucuccaagcaggaaaggggaaaaucucugcuauuuaagaccucagccgguguuaacaugugcacccucauugccauggaccugggcgaacuuugugaagauacuaugaccuacaaaugcccacagauaacagaggcggaaccggacgauguggacuguuggugcaaugcuaccgaugccuggguaacuuaugggacauguagucagaccggagagcaccggcgcgacaagcgaagcguggcacuggcaccccaugucggcuugggucucgagacgcguacugaaaccuggauguccucugagggggcuuggaaacagauccagagaguggaaacaugggcacugaggcacccuggauucacuguuauugccuuuuuccuggcucaugccaucggcaccucgauuacacaaaagggcaucauauuuauccucuuaaugcuggugaccccaucaauggcgaugcggugcgucgggauuggaaaccgcgauuucguggagggucuuagcggcgcaacguggguagacguuguguuggagcacgggaguugugucacuacaauggccaagaauaaacccacccuggauaucgaacuacucaagacugaggugacaaacccugcuauucugagaaaacuuugcaucgaagccaagauauccaauaccacgaccgacucuagguguccaacacagggagaggcaacucugguggaagaacaggaugcuaacuuugucugccggcgcaccuucguugaccgaggcugggguaauggguguggauuguuuggcaaaggcagccuccugacaugcgccaaguucaagugcgugacuaaauuagaggggaagauuguacaguacgaaaaccugaaauauuccgugaucgucaccgugcacacaggagaucaacaucagguugguaaugagaccacugaacacggcacgauugcgacaaucacaccccaggccccuacuucagagauccagcucaccgacuacggggcacuuacacuggacuguaguccaagaaccggauuggauuuuaacgaaauggugcuacugacuaugaaggagaaaagcuggcucguccauaagcaaugguuccuggaccuuccgcugcccuggacaucuggcgcuuccacgucacaggagaccuggaauaggcaggauuugcucgugacuuuuaaaacagcccacgcuaagaagcaagaaguaguugugcuggguagccaggagggggccaugcacaccgcauuaacaggcgccacugaaauucagaccaguggaacgaccacaauauucgcuggccaucugaaaugccggcuaaagauggacaaacucacucugaaggggaccucuuaugucauguguacaggauccuucaaacuugagaaggaaguggcggagacucagcacgguaccgucuuggugcaaguuaaguacgagggcacggaugcaccuugcaaaaucccauuuagcacacaggacgaaaagggggugacccagaacggacgucugauuacugccaaucccaucguaacagauaaagagaagccugucaacauagaaaccgagccacccuucggcgagucguauauugugguuggugcuggggaaaaagcccucaagcugucuugguuuaagaaaggcuccucaaucggaaagauguucgaggcaacugcccgcggcgcuagaaggauggccauccuuggggacaccgcaugggauuuuggaaguauugguggcguguucacaagcgucgggaaacuggugcaucagguauuuggaacggcguacggcguguuguucuccgguguuucuuggaccaugaagaucgggauuggcauacuccugacuugguuaggacugaauagccggucaacaagucuauccaugaccuguaucgcugucggcauggugacacucuaccugggggugaugguccaagccgacagcggaugcguuauuaacuggaaaggccgagaacuuaagugugguucugggaucuuugugacuaacgaggugcacaccuggacggaacaguauaaguuccaggcagauucaccgaaacgcuugagugccgcuaucggaaaggccugggaggagggcguaugcgguauuagaagcgcaacaaggcuggaaaauauaauguggaaacagaucuccaacgagcucaaucauauucuguuagaaaacgacaugaaguuuaccgucgugguuggcgacgcuaaugggauccuggcccaaggcaagaagaugauucggccucagcccauggagcacaaauacucuuggaagucguggggcaaggcgaaaaucauaggggccgauauccagaacacuaccuucauuaucgacggaccagauacaccugaaugucccgacaaucagcgcgcuuggaacauuugggagguggaggauuauggcuuugguaucuucacuaccaauauauggcuuaaguugagagacagcuacacacaaaugugcgaucacaggcucauguccgcagccauuaaagacucaaaggcuguccaugccgauaugggguauuggaucgaaagugagaaaaacgaaacguggaagcuggcacgugcgucuuucauugaggugaagaccuguacuuggccaaaaagccacacacuaugguccaauggaguucuggaaucagagaugaucauacccaagaucuacggcgguccuauuagccagcauaacuaucggucuggcuacuuuacccagacugccgggccauggcaccucggaaaacuggagcuugacuucgauuugugcgaaggcacaaccgugguagucgacgagcacugcgggaaucgaggaccgucccugagaacgacuaccgugacaggcaagaucauucaugaaugguguugcaggaguuguaccuuacccccucuccgcuuucggggugaggaugggugcugguacggaauggagaucagaccagugaaagaaaaggaggaaaaccuggucaggagcaugguuucugcuggcuccggugagguggacucauucagucuuggcauacugugugccagcauuaugaucgaagagguaaugcgcucgcgauggucccggaagauguugaugacugggacacucgcaguguuucugcuacuggucaugggacaacucaccuggaaugaccugauccgucuuugcauuauggugggcgcuaacgccucugauagaauggggaugggaacaacuuauuuggcacugauggccaccuucaaaaugaggcccauguuugcuguuggcuuacucuuccgccggcugacgagcagagaggugcuucugcuaacaaucggucucucacuggucgcgaguguggaauugccuaacucccuggaggaauuaggggacggacucgccaugggcauuaugaugcugaaacuucugaccgaguuucagccacaccaguuguggacuacccuccugucucuaacauucauaaaaacuacccugagccuugauuacgcauggaagacgacagcuauggcccucuccaucguuucacuguuucccuugugucugagcaccacaagucagaaaacaaccugguuaccggugcuccugggcucuuucgggugcaagccucuuacuauguuucugauuacagaaaauaagaucuggggaaggaaauccuggccauugaacgaggguauuauggccaucggcauagucagcauccuccugucgucacuacugaagaaugacguaccccuugcugggccucucauugcaggaggcaugcugaucgccuguuaugugauuucugguaguuccgcggauuugagcuuagagaaagcugccgaaguuucuugggagcaagaagcagagcauagcgggaccucccacaacauccugguggaaguccaggacgauggaacgaugaagauaaaagacgaggagcgagaugacacucucaccauucugcuuaaggccacacuguuggcugugucaggcguauaccccaugaguaucccagcaacccuauucgugugguauuucuggcagaaaaagaagcagcgcagcggcguccugugggauacaccuucucccccagaaguugagcgggccgugcucgacgaugggaucuacaggauucugcaacgaggacuuuuaggucguucccaggugggcgucgggguguuucaggacggaguuuuccauacuauguggcacguaacccgcggcgcggugcugauguaucaggguaaacggcucgaaccgucaugggcuagugucaagaaagacuugauaagcuacgggggaggcuggagauuucaaggcuccuggaauacgggggaggaggugcagguuaucgccguggaaccuggaaagaaccccaaaaauguccagacaacuccagguaccuucaagacacccgagggcgaagugggggcaauugcccuggauuuuaagccuggaaccucuggcucgccaaucguaaacagggaggguaaaauugucgggcucuacggaaauggcgugguuacuaccagcggcacauaugugucagcuaucgcccaagcaaaggcuucccaggaagggccccugccugagauagaggacgaagucuucaaaaagcgaaaccuuacgaucauggaucugcacccgggaagugguaaaacucggcgcuacuugccagccauugugagagaggcgaucaagaggaagcuacggacccugauucucgcccccacacgaguuguggcaucugaaauggcugaggccuuaaaaggcaugccuaucagauaucagaccacugcugucaagagcgaacauacagggcgcgagauaguggaccugaugugccacgcaaccuuuacgaugaggcuucuguccccaguacgugugcccaauuacaacaugauuaucauggaugaggcccauuucacugacccugccucaaucgcugcgcggggauauauuucuacaagaguuggcaugggugaagcagccgcuaucuuuaugaccgccaccccgcccgggagcgucgaggcauucccacagaguaaugccgugauacaagaugaagagagggacauuccugaacgcuccuggaacagcggauacgauuggaucacugacuuucccggcaaaacagugugguucgucccaucuauuaagucaggcaaugauaucgcuaacugucucagaaagaacgggaagagaguaauacaguugucccggaagaccuucgacacagaguaucagaaaacuaagaauaacgacugggauuacgugguuacgaccgacauuagugagaugggagcgaauuuuagggccgaucgcgugaucgacccucguagaugccugaaacccgucauccucaaggaugguccagaacgggugauucuggcaggcccgaugccuguuacaguggcuagcgccgcacagaggcgcgggcgaaucggaagaaaccaaaauaaagagggcgaccaguacgucuauaugggucagccccuuaacaaugaugaagaccacgcccauuggacugaggcuaagaugcuacuggauaacauuaauaccccagaggggauaauccccgccuuguucgaaccugagcgggaaaagucggcggcaauugacggcgaguacagguuacgcggagaagccagaaaaacauuuguggagcugaugaggcggggcgaucucccaguauggcugucuuauaagguggcuuccgagggguuccaguacagcgaccgucgcuggugcuuugauggagaacgaaacaaucaaguucuugaggaaaacauggacgucgagaucuggaccaaagaaggugagagaaagaaacugaggccccgguggcucgacgcccgcacuuauucagauccuuuggcucugagagaguucaaggaauuugcagccggcaggcggagugugucuggggaccuaauccuggagauuggaaaacucccgcagcaccuuacgucccgagcucagaaugcccuggauaacuuagugauguugcacaauagcgaacagggcgguaaggcauacagacaugcgauggaggaacugccagacaccauagagacacucaugcugcuugcccugaucgcuguccucacugggggcguuaccuuguucuuucugucaggaaagggcuuagggaaaacaaguauuggacuacugugugugaccgccagcuccgcacuccuuuggauggcuucuguagagccccacuggaucgccgcaagcauuauccuggaguucuuuuugauggugcugcucauaccugagcccgaucgccaaaggacuccacaggacaaccagcuggccuaugucgugaucggucuucucuucaugauucugacaguugcugcgaacgaaaugggcuugcuggagacgaccaagaaagauuuagggaucggacauguggccgcagagaaucaccaacacgcuacuaugcuagacgucgaucugcggccugccuccgccuggacacucuacgcaguagcuaccaccgugauuacacccaugaugcgucauacuaucgaaaacacgaccgccaauauaucacuuacagcgauugcuaaccaggccgcaauccugaugggcuuggacaaggguuggccaauuucuaaaauggauaucgggguuccucugcucgcccugggcugcuacagucaggugaauccgcuuacuuuaaccgcugcaguccugaugcucguggcccacuaugcgauaaucggacccggcuugcaggcuaaggccacaagagaggcacaaaagaggaccgccgcugggauuaugaaaaacccaacugucgacggaaucguggccauugaucuggacccuguuguguacgacgcaaaguuugaaaaacagcuaggccagaucaugcugcucauacuuuguacgucgcagauucuguugaugcgcacaaccugggcucugugcgagagcaucacucucgccaccgguccccugacaacuuuaugggaaggguccccaggaaaguucuggaauaccacaaucgcgguaucuauggccaacauuuuccggggcucauaucuugccggugcuggccuggccuuuagccucaugaaaucccuagggggaggccgaagagggacgggagcacaaggcgagacccugggugagaaguggaagaggcaguugaaucagcugaguaaaucugaguucaacacuuacaagcgcagcgggaucauggagguggaucggucagaagcuaaagagggacucaagagaggcgaaacaaccaaacaugccgucucccgugguacugccaaacuuaggugguuuguugagcggaaucuggugaagccugagggcaaagucauagacuugggguguggacgcggcggguggaguuauuacugcgcgggacugaagaaagugacagaaguaaagggcuauaccaaaggugggcccggacacgaggaaccgauuccaauggcuacguacggcuggaaccucgugaaguuacauagcggcaaagauguuuucuuuaugccucccgagaagugugacacccugcuuugcgauaucggggaaucuuccccaaaucccacaauugaggagggacgaacucugagagugcuaaagauggucgaaccuuggcucagggguaaccaguucuguaucaaaauacugaauccguacaugcccucaguggucgagaccuuggaacaaaugcagcggaagcacggcgggaugcuggugcgcaacccacucagcagaaauucgacacacgagauguauuggguuucuugcggaacuggcaacaucguaagugcagugaacaugaccuccaggaugcuucugaaucgauuuacaauggcccaucggaaaccuaccuacgagcgugacgucgauuuaggugcugggacuagacacguggccguugaacccgagguggcaaaccuggacauuaucggacagcgcauugaaaauaucaagaacgagcauaaaagcacguggcacuaugaugaagacaauccuuacaggacaugggccuaucacggcucauacgaggucaagccauccggcucugcuagcaguauggugaacgggguagugcgguugcucaccaagcccugggauguuauuccuauggucacucaaaucgcgaugaccgacacaacgccauucggacagcagagaguguuuaaagagaagguggacacccgcacucccagggccaaacgagguacaacccagauaauggaagucacugcaaaguggcuguggggcuuccuaucccggaauaaaaagccgagaauuuguacaagggaggaauuuacccgcaagguucguagcaacgcugccaucggggcaguguucguagaugagaaucaauggaacucugccaaagaagcuguggaggacgagcgguuuugggaucuuguccauagagaaagggagcugcacaagcagggaaaaugcgccacaugcguguauaauaugaugggcaagcgcgagaaaaagcucggugaguucgggaaggcgaaaggaucacgagcaaucugguacauguggcugggcgcccgguucuuggaauuugaggcucugggcuucaugaacgaggaccauugguuuaguagagaaaauucccucagcgggguugagggagaaggucuucacaagcugggcuacauuuuaagggauauaucuaaaaucccugggggaaacauguaugccgacgauacugcaggcugggacacccgcauuacggaggaugaccugcagaaugaggcuaagaucaccgaaauuauggagccagaacaugccuugcucgcuacaucgaucuucaaacugacuuaccagaacaagguggucagagugcaacggcccgccaaaaacgguaccguaauggauguuauaucaaggcgugaccagcgagggagcggacaggugggcacauauggccuaaauacuuuuaccaacauggagguccagcuuauccgccaaauggaauccgaggggauuuuccugccuagugagcucgaaacgccaaaucuggcagagagaguguuggauugguuagaaaagcacggagcggagcggcugaagaggauggccaucucuggugacgacuguguggucaaacccauugaugaccgcuuugcuacagcccucaccgcacuuaacgauaugggcaagguuagaaaagacaucccgcagugggaaccuagcaagggguggaaugauuggcaacaggugcccuucugcucccaccauuuucaccaacugauaaugaaagacggacgggagauuguagugccauguaggaaccaggaugagcuagucggccgagcucgugugucacagggugccggguggagucugagagaaacugcaugccucggaaagucuuacgcccaaauguggcaguugauguauuuccaucgccgggaccugaggcuugcggcuaaugccaucuguagcgcaguuccuguggauuggguccccacauccagaaccacuuggucaauccacgcccaccaucaguggaugaccacagaggacaugcugagcguguggaaccgcguauggauugaagagaauccauggauggaagauaagacgcacguuucuuccugggaggaggugcccuaccucggcaaacgggaagaccaguggugcggcaguuuaauagggcugaccgcuagggccacuugggcaacaaacauccaagucgcuauuaaucaggugcgaagauugaucggaaacgagaauuaucuggacuacaugaccagcaugaagcgguuuaaaaacgaaucggauccugagggugcccucugguga

SEQ ID NO: 13379 - RNA, 9879 nt, Artificial Sequence
  derived and/or modified CDS sequence (opt3) from DENV-1__KJ189331__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugaucgggacacuggccguguuccuacugcucauuaugggacaacugaccuggaaugaccuuauccguuugugcauuauggucggcgcaaacgcuuccgauagaauggggaugggaacaacuuaucuggccuuaauggcaaccuuuaaaaugaggccuauguucgccgugggccuccuguuucgccggcuuacgucuagagagguucugcuacucacaauaggucugagcuugguggcuucagucgaacugccaaacaguuuagaggaacucggggacggacuggcgaugggcaucaugaugcuuaagcuguugaccgaguuccagccccaccagcucuggacuacccugcuaucccugacauuuauuaaaacuacccuuucucucgauuacgccuggaagacgacagcaauggcucugagcaucguguccuuguucccgcuguguuuaucaaccacuagccagaaaacaaccuggcucccuguucugcuuggcaguuuugggugcaagccacugacuauguucuugauuacagaaaauaagaucuggggaaggaaaucuuggccccucaacgaggguauaauggccaucggcauuguguccauccugcuaagcucgcugcuuaagaaugacgucccucucgccgggccccugauugcuggaggcauguugaucgcauguuauguaauaucagguucuagugccgauuuaucccuggagaaaaccgcggaagugagcugggagcaagaagcugagcauucugggacgagccacaacauucucguugaagugcaggacgauggaacuaugaagaucaaagacgaggagcgagaugacacccugacaauccuucugaaggccaccuugcuagcagucuccggcguguacccaaugucaauuccugccacacuguuuguaugguauuucuggcagaaaaagaagcagcgcaguggcgugcucugggauacucccagcccaccggaagucgagcgggcuguucuggacgaugggauauacagaauccuucaaaggggauuacugggucguucucaggugggcgugggggucuuccaggacggaguguuucauaccauguggcacguuacgcgcggcgcaguacucauguaucaggguaaacgguuggaaccuuccugggccucagugaagaaagaccugauuaguuacgggggaggcuggagauuccaaggcagcuggaauacaggggaggagguccaggugaucgcgguugaacccggaaagaacccaaaaaaugugcagacuacccccgguacauuuaagaccccugagggcgaagucggggcuauugcccucgauuucaagccaggaacuuccggcucucccaucgugaacagggaggguaaaauaguagggcuguacggaaauggcgucgugaccacaucgggcacguauguuagcgcaaucgcccaagcuaaggccucacaggaagggccucuuccggagauugaggacgaaguguuuaaaaagcgaaaccugacuaucauggauuugcacccaggauccgguaaaacccggcgcuaccuacccgcaauugucagagaggcuaucaagaggaagcugcggacacucauauuagccccuacccgagugguugcgagugaaauggccgaggcacugaaaggcaugccaauuagauaucagacuacagcugugaagucugaacauaccgggcgcgagaucgucgaccuuaugugccacgccacguucacuaugaggcugcucagccccgugcguguaccuaauuacaacaugaucauuauggaugaggcucauuuuacagacccggcauccaucgccgcccggggauauauaucaaccagagugggcaugggugaagcugcggcaauuuucaugaccgccacucccccagggucuguugaggcuuuuccucagagcaaugccgucauccaagaugaagagagggacauucccgaacgcaguuggaacuccggauacgauuggaucacagacuucccaggcaaaaccgugugguuugugccuagcauaaagucuggcaaugauauugcaaacuguuugcgaaaaaacgggaagagagucauccagcugucacggaagacauucgacacugaguaucagaaaacgaagaauaacgacugggauuacguagugaccacagacaucuccgagaugggagccaauuucagggcugaucgcguuauugacccccguagaugccucaaaccagugauccugaaggaugguccggaacgggucauucuugcgggcccuaugcccgugacuguugccagugcagcucagaggcgcgggcgaauaggaagaaaccaaaauaaagagggcgaccaguacguguauaugggucagccacuaaacaaugaugaagaccacgcccauuggaccgaggcaaagaugcuguuggauaacaucaauacacccgaggggauuaucccugccuuauuugaaccagagcgggaaaagagcgcugccaucgacggcgaguacaggcugcgcggagaagcgagaaaaaccuucgucgagcucaugaggcggggcgaucugcccguguggcuuucguauaagguagcaucugagggguuucaguacuccgaccgucgcuggugcuucgauggagaacgaaacaaucaagugcuggaggaaaacauggacguugagauuuggacuaaagaaggugagagaaagaaacucaggccucggugguuggacgcccgcacguauagcgauccgcuggcucuaagagaguuuaaggaauucgccgcuggcaggcggucagucaguggggaccugauacucgagaucggaaaacuuccacagcaccugaccuuacgagcacagaaugccuuggauaaccuggcuaugcuccacaauucugaacagggcgguaaggccuacagacaugcaauggaggaacugcccgacacaauugagacucuuaugcugcucgcguugaucgccgugcugaccgggggcgugacauuauuuuuccuauccggaaagggccuggggaaaaccagcauuggacuccuuugugucacugcuucaagugcccuguuguggauggcaagcguugagccucacuggaucgcugccuccauaauccuggaauuuuuccucauggugcugcuuauucccgagccagaucgccaaaggacaccucaggacaaccagcucgcauauguagugaucggucuguuguuuaugauucugacggucgccgcuaacgaaaugggcuuacuagagaccacuaagaaagaucuggggaucggacauguggcggccgagaaucaccaacacgcaacaaugcucgacguugaucuucggcccgcuucugccuggacccuguacgccguggcaaccacagucauaacuccaaugaugcgucauacgauugaaaacaccacagcuaauaucagcuugacugccauugcgaaccaggcugccauccugaugggccucgacaaggguuggccuauauccaaaauggauaucgggguaccgcugcuugcauuaggcugcuacucacaggugaauccccugacccucacagccgcuguuuugaugcugguggcacacuaugccauuaucggaccaggccuacaggcgaaggcuaccagagaggcccaaaagaggacugcagccgggauuaugaaaaacccuacggucgacggaaucguggcuauagaucuggaccccgucguguacgacgccaaguucgaaaaacagcucggccagauuaugcuucugaucuuguguacaucucagauccugcucaugcgcaccacuugggcacugugcgagaguauuaccuuagcuacagguccacuuacuacccugugggaagggucgccuggaaaguuuuggaauacaacgaucgccguuagcauggcgaacauauuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauuauggagguggaucggucugaagcaaaagagggacugaagagaggcgaaaccacuaaacaugcuguaagccgugguacagccaaguugaggugguucguggagcggaaucuggucaagcccgagggcaaaguuaucgaccucggguguggacgcggcggguggucauauuacugcgccggauuaaagaaagugaccgaagucaagggcuauacgaaaggugggccgggacacgaggaaccaauuccuauggcgaccuacggcuggaaccuggugaagcuucauuccggcaaagauguauuuuucaugcccccagagaagugugacacacugcuaugcgauaucggggaaaguagccccaauccuacuauagaggagggacgaacccucagagugcugaagaugguugaaccgugguugagggguaaccaguuuuguaucaaaauucugaaucccuacaugccaucuguggucgagacacucgaacaaaugcagcggaagcacggcgggaugcuugugcgcaacccucuguccagaaauucaacucacgagauguauugggucagcugcggaaccggcaacaucgugucggcuguuaacaugacaucuaggauguuacugaaucgauucaccauggcacaucggaaacccacuuuugagcgugacguagauuugggugccgggacgagacacguggcugucgaaccugagguggccaaccucgacauuaucggacagcgcauugaaaauaucaagaacgagcauaaaaguacauggcacuacgaugaagacaauccauauaagaccugggcauaccacggcuccuaugagguuaagcccagcggcucagccuccucuauggugaacggggucgugaggcugcuaacuaaaccuugggauguaauaccaauggugacccaaauugcuaugacagacacgacccccuucggacagcagcggguuuuuaaggagaaagucgacacuagaacaccgcgcgcgaagagggguaccacucagaucauggaagugacagccaaauggcuuuggggcuuccugagccgaaauaagaagccucggaucuguaccagagaggaauuuacaaggaaagugcgcaguaacgcagcuauuggggccgucuucguugaugagaaucaauggaacuccgcaaaggaagccguggaggacgagcguuuuugggaucucguacaucgggaaagagagcugcacaaacagggaaagugcgcuacuugcguguacaauaugaugggcaaaagggaaaagaaguugggugaguucgggaaagccaagggaagccgcgcgauaugguauauguggcugggcgcacgauuccucgaauuugaggcccuuggcuucaugaacgaggaccauugguuuucucgggaaaauucacugaguggggucgagggagaagguuuacacaaacugggcuacaucuugagagauauuuccaagaucccagggggaaacauguacgcugacgauaccgccggcugggacacgaggauuaccgaggaugaccuccagaaugaggcaaaaaucacagauauaauggaacccgagcaugcucugcuagccacuagcaucuucaagcuuaccuaucagaacaaagugguucgcgugcaaagaccugcuaagaacgguacagucauggacgugauuucucggagggaucagcgugggucgggacagguaggcacuuacggccugaauaccuuuacgaacauggaaguucagcucauccgacaaauggagucagaagggauuuuccugccaagcgaguuggagacacccaauuuagccgaacgcgugcuggacuggcucgagaagcacggagcagaaagacuuaaacggauggcgaucuccggugacgauugugucgugaagccgauagacgauagguuugccaccgcucugacugcccuaaacgacaugggcaaagugcgcaaggauauuccucagugggagcccaguaaaggguggaaugacuggcagcaggucccauucugcucucaccauuuucaccaacugaucaugaaggauggaagagaaaucguugugccuugucggaaccaggacgagcucguaggcagggcacgagugagccagggugcugggugguccuugcgugagacagccugccugggaaagucauaugcacaaauguggcagcuuauguacuuccauagacgcgaucugcggcucgccgcgaaugcuauuuguagugccguccccguggacuggguuccaaccucuaggacuaccuggagcauacacgcacaccaucaguggaugacaacggaagauauguuauccguguggaacagagucuggaucgaggaaaaucccuggauggaggacaaaacccacgugucaagcugggaagagguaccuuaucugggcaagcgcgaggaccaguggugcggcucuuugauugggcugacugcccgggcuacaugggccaccaacauccaaguugcaauuaaucaggugaggcgacucaucggaaacgaaaauuaccuugauuauaugacuuccaugaaaagauuuaagaacgagagugacccagaaggugcucugugguga

SEQ ID NO: 13380 - RNA, 9879 nt, Artificial Sequence
  derived and/or modified CDS sequence (opt3) from DENV-1__KJ189332__SS-prME
agcgugaccaugcugcucaugcuucugcccacagcauuggcuuuccacuuaacuacgagaggaggggagccucauaugauagucuccaagcaggaaaggggaaaaucucuguuguuuaagaccucagccgguguuaacaugugcacccucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcacgaucuucauauuacugaugcuugugacuccaucaauggccaugcggugcgucgggaucggaaaccgcgauuuuguggaggguuugagcggcgcgacauggguagacguugugcuggagcacgggaguugugucaccacuauggcaaagaauaaacccacacuagauauugaacuccugaagaccgaggugacgaacccugccauccuuagaaaacugugcauugaagcuaagaucuccaauaccacaacugacucuagguguccaacccagggagaggccacauugguggaagaacaggaugcaaacuucgucugccggcgcacuuuuguugaccgaggcugggguaauggguguggacucuucggcaaaggcagccuguuaaccugcgcuaaguuuaagugcgugacaaaacuggaggggaagauaguacaguacgaaaaccucaaauauuccgugauugucaccgugcacacuggagaucaacaucagguugguaaugagacgacagaacacggcaccaucgccacuauuaccccacaggcgccuacaucagagauccagcuuaccgacuacggggcccugacuuuggacuguaguccaagaacaggacuagauuucaacgaaauggugcugcucacgaugaaggagaaaagcuggcugguccauaagcaaugguuucuugaccugccguugcccuggaccucuggcgcauccacuucacaggagacauggaauaggcaggaucuccuggugaccuucaaaacagcucacgccaagaagcaagaaguaguuguguuagguagccaggagggggcuaugcacacugcccugaccggcgcaacggaaauccagaccaguggaacaacuaccauuuuugccggccaucuaaaaugccggcucaagauggacaaacugacacuuaaggggacuucuuaugucauguguaccggauccuucaaauuggagaaggaaguggcugagacgcagcacgguacaguccuggugcaaguuaaguacgagggcaccgaugcgccuugcaaaauaccauucagcacucaggacgaaaagggggugacacagaacggacgucucaucaccgcaaaucccauuguaacugauaaagagaagccugucaacaucgaaaccgagccacccuuuggcgagucguauauagugguuggugccggggaaaaagcucugaaacuuucuugguucaagaaaggcuccucaauuggaaagauguuugaggccacagcacgcggcgccagaaggauggcuauccugggggacacggccugggauuucggaaguaucgguggcguguuuaccagcgucgggaaauuggugcaucagguauucggaacugcauacggcgugcucuuuuccgguguuucuuggacaaugaagauugggaucggcauucuguuaaccuggcugggacuaaauagccggucaacaagucucuccaugacuuguauagcggucggcauggugacccuguaccuuggggugaugguccaagcugacagcggaugcguuaucaacuggaaaggccgagaauugaagugugguucugggauuuucgugacgaacgaggugcacacauggaccgaacaguauaaguuucaggccgauucaccgaaacgccugagugcagccaucggaaaggcuugggaggagggcguaugcgguaucagaagcgccacuaggcucgaaaauauuauguggaaacagauauccaacgagcugaaucauaucuuacuggaaaacgacaugaaguucaccgucgugguuggcgacgcaaaugggauucuugcucaaggcaagaagaugauccggccucagcccauggagcacaaauacucuuggaagucguggggcaaggccaaaauuaucggggcggauauacagaacacaacuuuuaucauugacggaccagauaccccugaaugucccgacaaucagcgcgccuggaacaucugggagguggaggauuauggcuucgguauuuuuacaacgaauaucugguugaagcucagagacagcuacacccaaaugugcgaucacaggcugauguccgcugcaauaaaagacucaaaggccguccaugcugauaugggguauuggauugaaagugagaaaaacgaaacuuggaagcuagcccgugcaucuuucaucgaggugaagacauguaccuggccaaaaagccacacucugugguccaauggaguucucgaaucagagaugauuauccccaagauauacggcgguccuaucagccagcauaacuaucggccaggcuacuucacacagaccgcggggccguggcaccugggaaaacuugaguuggacuuugaucugugcgaaggcacgacugugguagucgacgagcacugcgggaaucgaggacccucuuuaagaaccacaaccgugacuggcaagauuauccaugaaugguguugcagguccuguacacucccuccacugcgcuuccggggugaggaugggugcugguacggaauggagauuagacccgugaaagaaaaggaggaaaaccuugucaggaguaugguuagcgccggcucuggugagguggacuccuuuucacugggcaucuugugugcuaguauaaugauugaagagguaaugcgcagccgauggucgcggaagaugcucaugaccgggacacuggccguguuccuacugcucaucaugggacaacugacuuggaaugaccuuauccguuugugcauuauggucggcgcaaacgcuuccgauagaauggggaugggaaccacguaucuggccuuaauggcaacauuuaaaaugaggccuauguucgccgugggccuccuguuucgccggcuuaccucuagagagguucugcuacucacuaucggucugagcuugguggcuucagucgaacugccaaacaguuuagaggaacucggggacggacuggcgaugggcauuaugaugcuuaagcuguugaccgaguuccagccccaccagcucuggacaacucugcuaucccugaccuuuauaaaaacgacacuuucucucgauuacgccuggaagaccacugcaauggcucugagcaucguguccuuguucccgcuguguuuaucaacaaccagccagaaaacuacauggcucccuguucugcuuggcaguuuugggugcaagccacugaccauguucuugauuacggaaaauaagaucuggggaaggaaaucuuggccccucaacgaggguauuauggccaucggcauaguguccauccugcuaagcucgcugcuuaagaaugacgucccucucgccgggccccugauugcuggaggcauguugaucgcauguuauguaauuucagguucuagugccgauuuaucccuggagaaaacugcggaagugagcugggagcaagaagcugagcauucugggaccagccacaacauccucguugaagugcaggacgauggaacaaugaagauaaaagacgaggagcgagaugacacccugacaauucuucugaaggccacuuugcuagcagucuccggcguguacccaaugucaaucccugccacccuguuuguaugguauuucuggcagaaaaagaagcagcgcaguggcgugcucugggauacgcccagcccaccggaagucgagcgggcuguucuggacgaugggaucuacaggauucuucaacgaggauuacugggucguucucaggugggcgugggggucuuccaggacggaguguuucauacaauguggcacguuacucgcggcgcaguacucauguaucaggguaaacgguuggaaccuuccugggccucagugaagaaagaccugauaaguuacgggggaggcuggagauuccaaggcagcuggaauaccggggaggagguccaggugaucgcgguugaacccggaaagaaccccaagaaugugcagacaacccccgguacuuuuaagaccccugagggcgaagucggggcuauugcccucgauuucaagccaggaacauccggcucucccaucgugaacagggaggguaaaauuguagggcuguacggaaauggcgucgugacgacuucgggcaccuauguuagcgcaaucgcccaagcuaaggccucacaggaagggccucuuccggagauagaggacgaaguguuuaaaaagcgaaaccugacaaucauggauuugcacccaggauccgguaaaacccggcgcuaccuacccgcaauugucagagaggcuaucaagaggaagcugcggacucucauuuuagccccuacacgagugguugcgagugaaauggccgaggcacugaaaggcaugccaaucagauaucagaccacggcugugaagucugaacauacugggcgcgagauagucgaccuuaugugccacgccacauucaccaugaggcugcucagccccgugcguguaccuaauuacaacaugauuaucauggaugaggcucauuuuaccgacccggcauccaucgccgcccggggauauauuucaacuagagugggcaugggugaagcugcggcaaucuucaugacagccacacccccagggucuguugaggcuuuuccucagagcaaugccgucauacaagaugaagagagggacauucccgaacgcaguuggaacuccggauacgauuggaucacagacuucccaggcaaaacugugugguuugugccuagcauuaagucuggcaaugauaucgcaaacuguuugagaaagaacgggaagagagucauacagcugucacggaagacguucgacaccgaguaucagaaaacaaagaauaacgacugggauuacguagugacuaccgacauuuccgagaugggagccaauuucagggcugaucgcguuaucgacccccguagaugccucaaaccagugauccugaaggaugguccggaacgggucauucuugcgggcccuaugcccgugacaguugccagugcagcucagaggcgcgggcgaaucggaagaaaccaaaauaaagagggcgaccaguacguguauaugggucagccacuaaacaaugaugaagaccacgcccauuggaccgaggcaaagaugcuguuggauaacauuaauacucccgaggggauaaucccugccuuauuugaaccagagcgggaaaagagcgcugccauugacggcgaguacaggcugcgcggagaagcgagaaaaacguucgucgagcucaugaggcggggcgaucugcccguguggcuuucguauaagguagcaucugagggguuucaguacuccgaccgucgcuggugcuucgauggagaacgaaacaaucaagugcuggaggaaaacauggacguugagaucuggaccaaagaaggugagagaaagaaacucaggccucggugguuggacgcccgcacauauagcgauccgcuggcucuaagagaguuuaaggaguucgccgcuggcaggcggucagucaguggggaccugauccucgagauuggaaaacuuccacagcaccugacuuuacgagcacagaaugccuuggauaaccuggcuaugcuccacaauucugaacagggcgguaaggccuacagacaugcaauggaggaacugcccgacaccauagagacacuuaugcugcucgcguugaucgccgugcugaccgggggcgugacuuuauuuuuccuauccggaaagggccuggggaaaacaagcauuggacuccuuugugucacggcuucaagugcccuguuguggauggcaagcguugagccucacuggaucgcugccuccauuauccuggaauuuuuccucauggugcugcuuauacccgagccagaucgccaaaggaccccucaggacaaccagcucgcauauguagugaucggucuguuguuuaugauucugacugucgccgcuaacgaaaugggcuuacuagagacaaccaagaaagaucuggggaucggacauguggcggccgagaaucaccaacacgcaaccaugcucgacguugaucuucggcccgcuucugccuggacacuguacgccguggcaacuacggucauuaccccaaugaugcgucauacaaucgaaaacacuaccgcuaauaucagcuugacagccauugcgaaccaggcugccauccugaugggccucgacaaggguuggccuauuuccaaaauggauaucgggguaccgcugcuugcauuaggcugcuacucacaggugaauccccugacccucacugccgcuguuuugaugcugguggcacacuaugccauaaucggaccaggccuacaggcgaaggcuacgagagaggcccaaaagaggacagcagccgggauuaugaaaaacccuaccgucgacggaaucguggcuauugaucuggaccccgucguguacgacgccaaguucgaaaaacagcucggccagaucaugcuucugauauuguguacuucucagauucugcucaugcgcaccacaugggcacugugcgagaguaucacuuuagcuaccgguccacuuacaacgcugugggaagggucgccuggaaaguuuuggaauaccacuaucgccguuagcauggcgaacauuuuccggggcuccuaucucgccggugcaggccuagcuuucucucugaugaaaucacuagggggaggccgaagagggacaggagcccaaggcgagacccugggugagaaguggaagaggcagcucaaucagcuuagcaaauccgaauuuaacacuuacaagcgcagugggaucauggagguggaucggucugaagcaaaagagggacugaagagaggcgaaacaaccaaacaugcuguaagccgugguacggccaaguugaggugguucguggagcggaaucuggucaagcccgagggcaaaguuauagaccucggguguggacgcggcggguggucauauuacugcgccggauuaaagaaagugaccgaagucaagggcuauacaaaaggugggccgggacacgaggaaccaauuccuauggcgacuuacggcuggaaccuggugaaacuucauuccggcaaagauguauuuuucaugcccccagagaagugugacacccugcuaugcgauaucggggaaaguagccccaauccuacaauugaggagggacgaacucucagagugcugaagaugguugaaccgugguugagggguaaccaguuuuguaucaaaauacugaaucccuacaugccaucuguggucgagacccucgaacaaaugcagcggaagcacggcgggaugcuugugcgcaacccucuguccagaaauucaacacacgagauguauugggucagcugcggaaccggcaacaucgugucggcuguuaacaugacuucuaggauguuacugaaucgauucacgauggcacaucggaaacccacauuugagcgugacguagauuugggugccgggaccagacacguggcugucgaaccugagguggccaaccucgacauuaucggacagcgcauugaaaauaucaagaacgagcauaaaaguacuuggcacuacgaugaagacaauccauauaagaccugggcauaccacggcuccuaugagguuaagcccagcggcucagccuccucuauggugaacggggucgugaggcugcuaacaaaaccuugggauguaauuccaauggugacgcaaaucgcuaugaccgacacuacacccuucggacagcagcggguuuuuaaggagaaagucgacaccagaacuccgcgcgcgaagagggguacaacccagauaauggaagugacagccaaauggcuuuggggcuuccugagccgaaauaagaagccucggauuuguacuagagaggaauuuaccaggaaagugcgcaguaacgcagcuaucggggccgucuucguugaugagaaucaauggaacuccgcaaaggaagccguggaggacgagcguuuuugggaucucguacaucgggaaagagagcugcacaaacagggaaagugcgcuacgugcguguacaauaugaugggcaaaagggaaaagaaguugggugaguucgggaaagccaagggaagccgcgcgaucugguauauguggcugggcgcacgauuccucgaauuugaggcccuuggcuucaugaacgaggaccauugguuuucucgggaaaauucacugaguggggucgagggagaagguuuacacaaacugggcuacauuuugagagauauauccaagaucccagggggaaacauguacgcugacgauaccgccggcugggacacaaggauuacugaggaugaccuccagaaugaggcaaaaaucaccgauauuauggaacccgagcaugcucugcuagccacaagcaucuucaaacuuacuuaucagaacaaagugguucgcgugcaaagaccugcuaagaacgguaccgucauggacgugauaucucggagggaucagcgugggucgggacagguaggcacguacggccugaauacauuuaccaacauggaaguucagcucauccgacaaauggagucagaagggauuuuccugccaagcgaguuggagacucccaauuuagccgaacgcgugcuggacuggcucgagaagcacggagcagaaagacuuaaacggauggcgaucuccggugacgauugugucgugaagccgauugacgauagguuugccacagcucugaccgcccuaaacgacaugggcaaagugcgcaaggauaucccucagugggagcccaguaaaggguggaaugacuggcagcaggucccauucugcucucaccauuuucaccaacugauaaugaaggauggaagagaaauuguugugccuugucggaaccaggacgagcucguaggcagggcacgagugagccagggugcugggugguccuugcgugagacugccugccugggaaagucauaugcacaaauguggcagcuuauguacuuccauagacgcgaucugcggcucgccgcgaaugcuaucuguagugccguccccguggacuggguuccaaccucuaggacaacguggagcauccacgcacaccaucaguggaugaccacugaagauauguuauccguguggaacagagucuggauugaggaaaaucccuggauggaggacaaaacacacgugucaagcugggaagagguaccuuaucugggcaagcgcgaggaccaguggugcggcucuuugauagggcugaccgcccgggcuacuugggccacaaacauccaaguugcaauuaaucaggugaggcgacucaucggaaacgaaaauuaccuugauuauaugaccuccaugaaaagauuuaagaacgagagugacccagaaggugcucugugguga

SEQ ID NO: 13381 - RNA, 9879 nt, Artificial Sequence
  derived and/or modified CDS sequence (opt3) from DENV-1__KJ189334__SS-prME
agcgugaccaugcugcucaugcuucugcccacugccuuggcuuuccacuuaacuacgagaggaggggaaccucauaugaucgucuccaagcaggaaaggggaaaaucucugcuguuuaagguuucagcuggugugaacaugugcacccucauugccauggaccugggcgagcuuugugaagauacaaugacuuacaaaugcccacagaucaccgaggcggaaccggacgauguagacuguuggugcaaugcuaccgauaccugggugacuuaugggacauguagucagaccggagagcaccggcgcgacaagcgaagcgucgcccuggcaccccaugugggcuugggucucgagacgcguacugaaaccuggauguccucugagggggccuggaaacagauccagagaguugaaacaugggcucugaggcacccuggauucacugugauugcauuuuuccuggcccaugcuaucggcaccucgauuacacaaaagggcaucauauuuauccucuuaaugcuggucaccccaucaauggccaugcggugcguggggauuggaaaccgcgauuucguagagggucuuagcggcgcgacguggguugacguggucuuggagcacgggaguugugugacuacaauggcaaagaauaaacccacccuggauaucgaacuacucaagacugaggugacaaacccugccauucugagaaaacuuugcaucgaagcuaagauauccaauaccacgaccgacucuagguguccaacacagggagaggccacucuggucgaagaacaggaugcaaacuuuguuugccggcgcaccuucguggaccgaggcugggguaauggguguggauuguuuggcaaaggcagccuccugacaugcgcuaaguucaagugcguaacuaaauuagaggggaagauugugcaguacgaaaaccugaaauauuccgucaucgugaccguucacacaggagaucaacaucagguggguaaugagaccacugaacacggcacgauugccacaaucaccccacaggcgccuacuucagagauccagcucaccgacuacggggcccuuacacuggacuguaguccaagaaccggauuggauuuuaacgaaaugguccuacugacuaugaaggagaaaagcuggcucgugcauaagcaaugguuccuggaccuuccgcugcccuggacaucuggcgcauccacgucacaggagaccuggaauaggcaggauuugcucguaacuuuuaaaacagcucacgccaagaagcaagaaguugugguccuggguagccaggagggggcuaugcacaccgccuuaacaggcgcaacugaaauucagaccaguggaacgaccacaauauucgccggccaucugaaaugccggcuaaagauggacaaacucacucugaaggggaccucuuaugugauguguacaggauccuucaaacuugagaaggaagucgcugagacucagcacgguaccguguugguucaagugaaguacgagggcacggaugcgccuugcaaaaucccauuuagcacacaggacgaaaaggggguaacccagaacggacgucugauuacugcaaaucccaucgucacagauaaagagaagccugugaacauagaaaccgagccacccuucggcgagucguauauuguugugggugccggggaaaaagcucucaagcugucuugguuuaagaaaggcuccucaaucggaaagauguucgaggccacugcacgcggcgccagaaggauggcuauccuuggggacaccgccugggauuuuggaaguauugguggcgucuucacaagcguggggaaacugguacaucagguguuuggaacggcauacggcguuuuguucuccggugucucuuggaccaugaagaucgggauuggcauacuccugacuugguuaggacugaauagccggucaacaagucuauccaugaccuguaucgcggugggcauggugacacucuaccugggggucaugguucaagcugacagcggaugcgugauuaacuggaaaggccgagaacuuaagugugguucugggaucuuugugacuaacgagguacacaccuggacggaacaguauaaguuccaggccgauucaccgaaacgcuugagugcagccaucggaaaggcuugggaggagggcgucugcgguauuagaagcgccacaaggcuggaaaauauaauguggaaacagaucuccaacgagcucaaucauauucuguuagaaaacgacaugaaguuuaccgugguugugggcgacgcaaaugggauccuggcucaaggcaagaagaugauucggccucagcccauggagcacaaauacucuuggaagucguggggcaaggccaaaaucauaggggcggauauccagaacacuaccuucauuaucgacggaccagauacaccugaaugucccgacaaucagcgcgccuggaacauuugggaggucgaggauuauggcuuugguaucuucacuaccaauauauggcuuaaguugagagacagcuacacacaaaugugcgaucacaggcucauguccgcugcaauuaaagacucaaaggccgugcaugcugauaugggguauuggaucgaaagugagaaaaacgaaacguggaagcuggcccgugcaucuuucauugagguuaagaccuguacuuggccaaaaagccacacacuaugguccaauggagugcuggaaucagagaugaucauacccaagaucuacggcgguccuauuagccagcauaacuaucggccaggcuacuuuacccagacugcggggccguggcaccucggaaaacuggagcuugacuucgauuugugcgaaggcacaaccguagucguggacgagcacugcgggaaucgaggacccucucugagaacgacuaccgugacaggcaagaucauucaugaaugguguugcagguccuguaccuuaccuccacuccgcuuucggggugaggaugggugcugguacggaauggagaucagacccgucaaagaaaaggaggaaaaccugguuaggaguauggugagcgccggcucuggugagguagacuccuucucacuuggcauacugugugugaguauuaugaucgaagaggucaugcgcagccgauggucgcggaagauguugaugacugggacacucgcuguguuucugcuacugguuaugggacaacucaccuggaaugaccugauccgucuuugcauuauggugggcgccaacgcauccgauagaauggggaugggaacaacuuauuuggcucugauggccaccuucaaaaugaggccuauguuugcagucggcuuacucuuccgccggcugacgucuagagaggugcuucugcuaacaaucggucucagccugguugccucaguggaauugccaaacagucuggaggaauuaggggacggacucgcuaugggcauuaugaugcugaaacuucugaccgaguuucagccccaccaguuguggacuacccuccugucccuaacauucauaaaaacuacccugucucuugauuacgcguggaagacgacagccauggcacucagcaucgucucccuguuuccguugugucugucaaccacuagccagaaaacaaccugguuaccuguacuccugggcaguuucgggugcaagccacuuacuauguuucugauuacagaaaauaagaucuggggaaggaaaucuuggcccuugaacgaggguauuauggcuaucggcauaguguccauccuccugagcucgcuacugaagaaugacguuccucuugccgggccccucauugccggaggcaugcugaucgcuuguuaugugauuucagguucuagugcagauuuguccuuagagaaagccgcggaagucagcugggagcaagaagcugagcauucugggaccagccacaacauccugguggaaguacaggacgauggaacgaugaagauaaaagacgaggagcgagaugacacucucaccauucugcuuaaggccacacuguuggcaguguccggcgucuacccaaugucaaucccugccacccuauucguuugguauuucuggcagaaaaagaagcagcgcaguggcgugcugugggauacacccagcccaccggaaguggagcgggcuguccucgacgaugggaucuacaggauucugcaacgaggacuuuuaggucguucucaggugggcguugggguauuucaggacggaguguuccauacuauguggcacgucacccgcggcgcagugcugauguaucaggguaaacggcucgaaccuuccugggccucaguuaagaaagacuugauaaguuacgggggaggcuggagauuucaaggcagcuggaauacgggggaggaggugcaggucaucgcgguggaacccggaaagaaccccaaaaauguacagacaacucccgguaccuucaagacaccugagggcgaagucggggcuauugcccuggauuuuaagccaggaaccuccggcucucccaucgugaacagggaggguaaaauuguugggcucuacggaaauggcguggucacuaccucgggcacauaugugagcgcaaucgcccaagcuaaggccucacaggaagggccucugccggagauagaggacgaaguuuucaaaaagcgaaaccuuacgaucauggaucugcacccaggauccgguaaaacucggcgcuacuugcccgcaauugugagagaggcuaucaagaggaagcuacggacccugauucucgccccuacacgagucguggcgagugaaauggccgaggcauuaaaaggcaugccaaucagauaucagaccacugcuguaaagucugaacauacagggcgcgagauaguggaccugaugugccacgccaccuuuacgaugaggcuucugagccccguucgugucccuaauuacaacaugauuaucauggaugaggcucauuucacugacccggcauccaucgccgcccggggauauauuucaacaagagugggcaugggugaagcugcggcaaucuuuaugaccgccacacccccagggucuguggaggcuuucccucagagcaaugccgucauacaagaugaagagagggacauucccgaacgcaguuggaacuccggauacgauuggaucacugacuuuccaggcaaaacaguaugguucgugccuagcauuaagucuggcaaugauaucgcaaacugucucagaaagaacgggaaaagaguuauacaguugucacggaagaccuucgacacagaguaucagaaaacuaagaauaacgacugggauuacguggucacgaccgacauuuccgagaugggagccaauuuuagggcugaucgcgugaucgacccccguagaugccugaaaccaguuauccucaaggaugguccggaacgggugauucuggcgggcccuaugcccgucacaguggccagugcagcucagaggcgcgggcgaaucggaagaaaccaaaauaaagagggcgaccaguacguauauaugggucagccacuuaacaaugaugaagaccacgcccauuggacugaggcaaagaugcuacuggauaacauuaauacccccgaggggauaaucccugccuuguucgaaccagagcgggaaaagaacgcugccauugacggcgaguacagguuacgcggagaagcgagaaaaacauuuguggagcugaugaggcggggcgaucuccccguuuggcugagcuauaaggucgcaucggagggguuccaguacucugaccgucgcuggugcuuugauggagaacgaaauaaccaagugcuugaggaaaauauggacguggagaucuggaccaaagaaggugagagaaagaaacugaggccucgguggcucgacgcccgcacuuauuccgauccguuggcucugagagaguucaaggaauuugccgcuggcaggcggagcgucucaggggaccuaauccuggagauuggaaaacucccacagcaccuuacgcugcgagcacagaacgccuuagauaauuugguuaugcugcacaacagugaacagggcgguaaggcuuacagacaugccauggaggaacuccccgacaccauagagacacugaugcuucuggcacucaucgcgguguugacugggggcguaacccuguucuuuuuaucuggaaagggccuagggaaaacauccauuggacugcucugugugaccgccagcucagcacuucuguggauggccagugucgagccucacuggaucgcagcuagcauuaucuuggaguucuuucugauggugcuccugauacccgagccagaucgccaaaggacuccucaggacaaccagcuugccuauguugugaucggucuccuguucaugauuuugacagucgcagccaaugaaaugggccuguuagagacgaccaagaaagaucuagggaucggacauguagcugcggagaaccaccaacacgccacuaugcuggacguggaucuccggcccgcauccgcuuggacacuuuacgccguugccaccaccgugauuacaccaaugaugcgucauacuaucgaaaauacgaccgcaaacauaucucugacagcuauugccaaucaggcggcuaucuugaugggccuggacaaggguuggccuauuagcaaaauggauaucggggucccgcuccuggcccuuggcugcuacucccaggugaaccccuuaacucugaccgcagccguccucauguugguggcucacuaugcaauaaucggaccaggccugcaggccaaggcgacaagagaggcucaaaagaggaccgccgcagggauuaugaaaaauccuacuguugacggaaucguggccauugaucuagaccccguaguguacgacgcuaaguuugaaaaacagcugggccagaucaugcuccuuauacuguguacgucacagauuuugcugaugcgcacaaccugggcccucugcgagucuaucacucuggcaaccgguccauuaacaacucuuugggaagggaguccuggaaaguucuggaacaccacaaucgcugucucgauggccaauauuuuccggggcagcuaucuggcgggugccggccucgcauuuucccuaaugaaaucucuagggggaggccgaagagggacgggagcucaaggcgagaccuugggugagaaguggaagaggcagcugaaccagcucucaaaaagcgaguucaauacuuacaagcgcuccgggaucauggagguugaucggagugaagccaaagagggacuuaagagaggcgaaacaaccaaacaugcagugucucgugguacugcuaagcugaggugguuugucgagcggaacuuggugaagcccgagggcaaaguaauagaccugggguguggacgcggcggguggagcuauuacugcgccggacucaagaaagugacagaaguuaagggcuauaccaaaggugggccgggacacgaggaaccaauuccuauggccacguacggcuggaauuuagugaagcugcauucaggcaaagaugucuucuuuauacccccagagaagugugacacccuucugugcgauauuggggaauccagucccaacccuacaaucgaggagggacgaacucuaagagugcucaagauggucgaaccguggcugagggguaaucaguucuguauaaaaaucuugaaccccuacaugccaagcgugguugaggcgcuggaacaaaugcagcggaagcacggcgggaugcucguacgcaauccucuuucuagaaacuccacccacgagauguauugggugucaugcggaacaggcaacauugucagcgcugugaauaugacuucgaggaugcuguuaaaccgauuuaccauggcacaucggaaacccacauacgagcgugacguugaucugggugccgggaccagacacguggcugucgaaccugagguggccaauuuggacaucauuggacagcgcaucgaaaacauuaagaaugagcauaaaucuacuuggcacuaugaugaagacaacccauacaagacgugggcauaucacggcaguuacgagguaaagcccuccggcagcgccucauccauggugaaugggguugucaggcuccugacaaaaccuugggaugugaucccaauggugacccaaauagcuaugacugacaccacacccuucggacagcagcgggucuuuaaggagaaaguugacacgagaaccccgcgcgcgaagagggguacuacacagauuauggaagugaccgccaaauggcuauggggcuuccuuucucgaaacaagaagccucggaucuguacuagagaggaauuuacaaggaaaguacgcagcaaugcagcuaucggggccguguucgucgaugagaaccaauggaauagugcaaaggaagccguggaggacgagcguuuuugggaucugguucaucgggaaagagagcuccacaaacagggaaagugcgcuaccugcguguauaacaugaugggcaaaagggaaaagaagcugggugaguucgggaaagccaagggaucccgcgcgauuugguacaugugguugggcgcacgauuccuggaauuugaggcccucggcuucaugaaugaggaccauugguuuagccgggaaaacucucuuucaggggucgagggagaaggucugcacaaauuaggcuacauacugagagauaucaguaagauuccagggggaaauauguaugcugacgauacagccggcugggacacuaggaucaccgaggaugacuugcagaacgaggcaaaaauuacggaaaucauggagcccgaacaugcucuccuggccaccuccauauucaagcuaacauaccagaacaaagugguacgcguucaaagaccugcuaagaaugguacugugauggaugucaucagccggagggaccagcgugggucuggacaggugggcaccuauggccuuaacacauuuacuaauauggaggugcagcugauucgacaaauggaaucggaggggaucuuccucccaucagagcuggaaacccccaacuuggccgagcgcgucuuagauuggcuggaaaagcacggagcagagagacucaaacggauggcgauuagcggugacgacuguguugugaagccgaucgaugacagguuugccacggcucuuacagcccugaaugauaugggcaaaguacgcaaggacauaccucagugggaacccuccaaaggguggaacgauuggcaacaggugccauucugcagucaccauuuucaccaacuaauuaugaaggacggaagagagaucgucgugccuugucggaaucaggaugagcugguuggcagggcacgagugucucagggugcuggguggagccuccgugaaaccgccugcuugggaaaguccuacgcacaaauguggcagcugauguauuuccauagacgcgaccuucggcuggccgcgaacgcuaucuguucagccguccccguggauuggguaccaacaaguaggacaaccuggucuauucacgcacaccaucaguggaugacuaccgaggacaugcucagcguuuggaauagaguguggauagaagagaaccccuggauggaagauaaaacacacgucuccucaugggaggaggugccuuacuuaggcaagcgcgaagaccaguggugcggcagccugaucggguugacggcccgggcuaccugggccacuaauauucaaguugcaaucaaccaggugaggcgacugauuggaaaugagaacuaucucgacuacaugacaucuaugaaaagauuuaagaaugaauccgauccagagggugcucuuugguga

SEQ ID NO: 13382 - RNA, 9879 nt, Artificial Sequence
  derived and/or modified CDS sequence (opt3) from DENV-1__KJ189335__SS-prME
agcgugaccaugcugcucaugcuucugcccacagccuuggcuuuccacuuaacuacgagaggaggggaaccucauaugaucgucuccaagcaggaaaggggaaaaucucugcuguuuaagaccucagcugguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcauuuuuccuggcccaugcuaucggcacaucgauuacccaaaagggcaucauauuuauccucuuaaugcuggugacgccaucaauggccaugcggugcgucgggauuggaaaccgcgauuucguggagggucuuagcggcgcgacuuggguagacguuguguuggagcacgggaguugugucacaaccauggcaaagaauaaacccacucuggauaucgaacuacucaagacagaggugaccaacccugccauucugagaaaacuuugcaucgaagcuaagauauccaauacgaccacagacucuagguguccaacucagggagaggccacccugguggaagaacaggaugcaaacuuugucugccggcgcacauucguugaccgaggcugggguaauggguguggauuguuuggcaaaggcagccuccugacuugcgcuaaguucaagugcgugaccaaauuagaggggaagauuguacaguacgaaaaccugaaauauuccgugaucgucacagugcacaccggagaucaacaucagguugguaaugagacuacggaacacggcacaauugccaccaucacuccccaggcgccuaccucagagauccagcucacagacuacggggcccuuacccuggacuguaguccaagaacuggauuggauuuuaacgaaauggugcuacugacaaugaaggagaaaagcuggcucguccauaagcaaugguuccuggaccuuccgcugcccuggacgucuggcgcauccaccucacaggagacuuggaauaggcaggauuugcucgugacauuuaaaaccgcucacgccaagaagcaagaaguaguugugcuggguagccaggagggggcuaugcacacagccuuaacuggcgcaaccgaaauucagacgaguggaaccacaacuauauucgccggccaucugaaaugccggcuaaagauggacaaacucacccugaaggggacaucuuaugucauguguacuggauccuucaaacuugagaaggaaguggcugagacccagcacgguacggucuuggugcaaguuaaguacgagggcacagaugcgccuugcaaaaucccauuuagcacccaggacgaaaagggggugacucagaacggacgucugauuacagcaaaucccaucguaaccgauaaagagaagccugucaacauagaaacugagccacccuucggcgagucguauauugugguuggugccggggaaaaagcucucaagcugucuugguuuaagaaaggcuccucaaucggaaagauguucgaggccaccgcacgcggcgccagaaggauggcuauccuuggggacacagccugggauuuuggaaguauugguggcguguucacgagcgucgggaaacuggugcaucagguauuuggaaccgcauacggcguguuguucuccgguguuucuuggacuaugaagaucgggauuggcauacuccugacaugguuaggacugaauagccggucaaccagucuauccaugacauguaucgcggucggcauggugacucucuaccugggggugaugguccaagcugacagcggaugcguuauuaacuggaaaggccgagaacuuaagugugguucugggaucuuugugaccaacgaggugcacacguggacagaacaguauaaguuccaggccgauucaccgaaacgcuugagugcagccaucggaaaggcuugggaggagggcguaugcgguauuagaagcgccaccaggcuggaaaauauaauguggaaacagaucuccaacgagcucaaucauauucuguuagaaaacgacaugaaguuuacugucgugguuggcgacgcaaaugggauccuggcucaaggcaagaagaugauucggccucagcccauggagcacaaauacucuuggaagucguggggcaaggccaaaaucauaggggcggauauccagaacaccacauucauuaucgacggaccagauacuccugaaugucccgacaaucagcgcgccuggaacauuugggagguggaggauuauggcuuugguaucuucaccacaaauauauggcuuaaguugagagacagcuacacgcaaaugugcgaucacaggcucauguccgcugcaauuaaagacucaaaggccguccaugcugauaugggguauuggaucgaaagugagaaaaacgaaaccuggaagcuggcccgugcaucuuucauugaggugaagacuuguacauggccaaaaagccacacccuaugguccaauggaguucuggaaucagagaugaucauacccaagaucuacggcgguccuauuagccagcauaacuaucggccaggcuacuuuacucagacagcggggccguggcaccucggaaaacuggagcuugacuucgauuugugcgaaggcaccacggugguagucgacgagcacugcgggaaucgaggacccucucugagaacuaccacagugaccggcaagaucauucaugaaugguguugcagguccuguacuuuaccuccacuccgcuuucggggugaggaugggugcugguacggaauggagaucagacccgugaaagaaaaggaggaaaaccuggucaggaguaugguuagcgccggcucuggugagguggacuccuucucacuuggcauacuguguguaaguauuaugaucgaagaggugaugcgcagccgauggucgcggaagauguugaugacagggacccucgcugucuuucugcuacuggugaugggacaacucacauggaaugaccugauccgucuuugcauuaugguuggcgccaacgcauccgauagaauggggaugggaacuaccuauuuggcucugauggccacguucaaaaugaggccuauguuugcagugggcuuacucuuccgccggcugacaucuagagagguccuucugcuaaccaucggucucagccugguggccucaguugaauugccaaacagucuggaggaauuaggggacggacucgcuaugggcauuaugaugcugaaacuucugacugaguuucagccccaccaguuguggaccacacuccugucccuaacuuucauaaaaaccacgcugucucuugauuacgcguggaagacaaccgccauggcacucagcaucgugucccuguuuccguugugucugucaacuacaagccagaaaaccacuugguuaccuguccuccugggcaguuucgggugcaagccacuuacaauguuucugauuaccgaaaauaagaucuggggaaggaaaucuuggcccuugaacgaggguauuauggcuaucggcauaguauccauccuccugagcucgcuacugaagaaugacgugccucuugccgggccccucauugccggaggcaugcugaucgcuuguuauguuauuucagguucuagugcagauuuguccuuagagaaagccgcggaagugagcugggagcaagaagcugagcauucugggacgagccacaacauccuggucgaagugcaggacgauggaacuaugaagauaaaagacgaggagcgagaugacacccucacaauucugcuuaaggccacccuguuggcaguauccggcguguacccaaugucaaucccugccacacuauucgucugguauuucuggcagaaaaagaagcagcgcaguggcguucugugggauacucccagcccaccggaaguggagcgggcugugcucgacgaugggaucuacaggauucugcaacgaggacuuuuaggucguucucaggucggcguggggguuuuucaggacggaguauuccauaccauguggcacgugacgcgcggcgcaguccugauguaucaggguaaacggcucgaaccuuccugggccucagugaagaaagacuugauaaguuacgggggaggcuggagauuucaaggcagcuggaauacaggggaggagguucaggugaucgcggucgaacccggaaagaaccccaaaaaugugcagacuacccccgguacauucaagaccccugagggcgaaguaggggcuauugcccuggauuuuaagccaggaacuuccggcucucccaucgucaacagggaggguaaaauuguggggcucuacggaaauggcguugugaccacaucgggcacguaugucagcgcaaucgcccaagcuaaggccucacaggaagggccucugccggagauagaggacgaaguguucaaaaagcgaaaccuuacuaucauggaucugcacccaggauccgguaaaacccggcgcuacuugcccgcaauuguuagagaggcuaucaagaggaagcuacggacacugauucucgccccuacccgaguggucgcgagugaaauggccgaggcauuaaaaggcaugccaaucagauaucagacuacagcugugaagucugaacauaccgggcgcgagauaguagaccugaugugccacgccacguuuacuaugaggcuucugagccccgugcguguuccuaauuacaacaugauuaucauggaugaggcucauuucacagacccggcauccaucgccgcccggggauauauuucaaccagagucggcaugggugaagcugcggcaaucuuuaugaccgccacucccccagggucuguggaggcuuucccucagagcaaugccgugauacaagaugaagagagggacauucccgaacgcaguuggaacuccggauacgauuggaucacagacuuuccaggcaaaaccgucugguucguaccuagcauuaagucuggcaaugauaucgcaaacugucucagaaagaacgggaaaagagugauacaguugucacggaagacauucgacacugaguaucagaaaacgaagaauaacgacugggauuacguugugaccacagacauuuccgagaugggagccaauuuuagggcugaucgcgucaucgacccccguagaugccugaaaccagugauccucaaggaugguccggaacggguuauucuggcgggcccuaugcccgugacugucgccagugcagcucagaggcgcgggcgaaucggaagaaaccaaaauaaagagggcgaccaguacguguauaugggucagccacuuaacaaugaugaagaccacgcccauuggaccgaggcaaagaugcuacuggauaacauuaauacacccgaggggauaaucccugccuuguucgaaccagagcgggaaaagaacgcugccauugacggcgaguacagguuacgcggagaagcgagaaaaaccuuuguagagcugaugaggcggggcgaucuccccguguggcugagcuauaagguugcaucggagggguuccaguacucugaccgucgcuggugcuuugauggagaacgaaauaaccaaguccuugaggaaaauauggacguggagaucuggacuaaagaaggugagagaaagaaacugaggccucgguggcucgacgcccgcacguauuccgauccguuggcucugagagaguucaaggaauuugccgcuggcaggcggagcgugucaggggaccuaauccuggagauuggaaaacucccacagcaccuuacccugcgagcacagaacgccuuagauaauuuggucaugcugcacaacagugaacagggcgguaaggcuuacagacaugccauggaggaacuccccgacacaauagagacucugaugcuucuggcacucaucgcgguuuugaccgggggcgugacacuguucuuuuuaucuggaaagggccuagggaaaaccuccauuggacugcucuguguaacugccagcucagcacuucuguggauggccaguguggagccucacuggaucgcagcuagcauuaucuuggaguucuuucugaugguccuccugauacccgagccagaucgccaaaggacaccucaggacaaccagcuugccuaugugguuaucggucuccuguucaugauuuugacgguggcagccaaugaaaugggccuguuagagaccacuaagaaagaucuagggaucggacaugucgcugcggagaaccaccaacacgccacaaugcuggacguagaucuccggcccgcauccgcuuggacccuuuacgccguggccaccacaguuauuacuccaaugaugcgucauacgaucgaaaauaccacagcaaacauaucucugacugcuauugccaaucaggcggcuaucuugaugggccuggacaaggguuggccuauuagcaaaauggauaucggggugccgcuccuggcccuuggcugcuacucccaggucaaccccuuaacccugacagcagccgugcucauguuggucgcucacuaugcaauaaucggaccaggccugcaggccaaggcgaccagagaggcucaaaagaggacugccgcagggauuaugaaaaauccuacgguggacggaaucguugccauugaucuagaccccgugguauacgacgcuaaguuugaaaaacagcugggccagaucaugcuccuuauacuguguacaucacagauuuugcugaugcgcaccacuugggcccucugcgagucuaucacccuggcaacagguccauuaacuacccuuugggaagggaguccuggaaaguucuggaacacaacgaucgcugugucgauggccaauauuuuccggggcagcuaucuggcgggugccggccucgcauuuucccuaaugaaaucucuagggggaggccgaagagggaccggagcucaaggcgagacuuugggugagaaguggaagaggcagcugaaccagcucucaaaaagcgaguucaauacauacaagcgcuccgggaucauggaggucgaucggagugaagccaaagagggacuuaagagaggcgaaaccacuaaacaugcaguuucucgugguacagcuaagcugaggugguuuguggagcggaacuuggucaagcccgagggcaaagugauagaccugggguguggacgcggcggguggagcuauuacugcgccggacucaagaaaguaaccgaagugaagggcuauacgaaaggugggccgggacacgaggaaccaauuccuauggccaccuacggcuggaauuuaguuaagcugcauucaggcaaagauguguucuuuaucccaccagagaagugugacacacuucugugcgauauuggggaauccagucccaacccuacuaucgaggagggacgaacccuaagaguccucaagaugguggaaccguggcugagggguaaucaguucuguauaaaaaucuugaaccccuacaugccaagcgucguggaggcgcuggaacaaaugcagcggaagcacggcgggaugcucguucgcaauccucuuucuagaaacuccacacacgagauguauuggguaucaugcggaacuggcaacauugugagcgcugucaauaugaccucgaggaugcuguuaaaccgauuuacaauggcacaucggaaacccaccuacgagcgugacguggaucugggugccgggacuagacacguugcuguggaaccugaggucgccaauuuggacaucauuggacagcgcaucgaaaacauuaagaaugagcauaaaucuacguggcacuaugaugaagacaacccauacaagacaugggcauaucacggcaguuacgaggugaagcccuccggcagcgccucauccaugguaaauggggugguuaggcuccugaccaaaccuugggaugucaucccaauggugacucaaauagcuaugaccgacacaacgcccuucggacagcagcggguguuuaaggagaaagucgacaccagaacuccgcgcgcgaagagggguacaacccagauuauggaaguuacugccaaauggcuauggggcuuccuuucucgaaacaagaagccucggaucuguacaagagaggaauuuaccaggaaagugcgcagcaaugcagcuaucggggccguauucguggaugagaaccaauggaauagugcaaaggaagccgucgaggacgagcguuuuugggaucuggugcaucgggaaagagagcuccacaaacagggaaagugcgcuacaugcguuuauaacaugaugggcaaaagggaaaagaagcugggugaguucgggaaagccaagggaucccgcgcgauuugguacaugugguugggcgcacgauuccuggaauuugaggcccucggcuucaugaaugaggaccauugguuuagccgggaaaacucucuuucagggguggagggagaaggucugcacaaauuaggcuacauacugagagauaucaguaagauuccagggggaaauauguaugcugacgauacugccggcugggacaccaggaucacggaggaugacuugcagaacgaggcaaaaauuaccgaaaucauggagcccgaacaugcucuccuggccacauccauauucaagcuaacuuaccagaacaaagucgugcgcguacaaagaccugcuaagaaugguaccguuauggaugugaucagccggagggaccagcgugggucuggacaggucggcacauauggccuuaacacuuuuaccaauauggaggugcagcugauucgacaaauggaaucggaggggaucuuccucccaucagagcuggaaacgcccaacuuggccgagcgcguguuagauuggcuggaaaagcacggagcagagagacucaaacggauggcgauuagcggugacgacugugucguuaagccgaucgaugacagguuugccacagcucuuaccgcccugaaugauaugggcaaagugcgcaaggacauaccucagugggaacccuccaaaggguggaacgauuggcagcagguaccauucugcagucaccauuuucaccaacuaauuaugaaggacggaagagagaucguggucccuugucggaaucaggaugagcuggugggcagggcacgaguuucucagggugcuggguggagccuccgugaaacugccugcuugggaaaguccuacgcacaaauguggcagcugauguauuuccauagacgcgaccuucggcuggccgcgaacgcuaucuguucagccgugcccgucgauugggugccaacaaguaggaccacuuggucuauucacgcacaccaucaguggaugaccacagaggacaugcucagcguauggaauagaguuuggauagaagagaaccccuggauggaagauaaaacgcacguguccucaugggaggaggucccuuacuuaggcaagcgcgaagaccaguggugcggcagccugaucggguugaccgcccgggcuacuugggccacaaauauucaaguggcaaucaaccagguuaggcgacugauuggaaaugagaacuaucucgacuacaugaccucuaugaaaagauuuaagaaugaauccgauccagagggugcucuuugguga

SEQ ID NO: 13383 - RNA, 9879 nt, Artificial Sequence
  derived and/or modified CDS sequence (opt3) from DENV-1__KJ189336__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauugugacucuguaccuuggggugaugguccaagcugacagcggaugcguuaucaacuggaaaggccgagaauugaagugugguucugggaucuucgugaccaacgaggugcacacguggacagaacaguauaaguuucaggccgauucaccgaaacgccugagugcagccauuggaaaggcuugggaggagggcguaugcgguauaagaagcgccaccaggcucgaaaauaucauguggaaacagauuuccaacgagcugaaucauaucuuacuggaaaacgacaugaaguucacugucgugguuggcgacgcaaaugggauucuugcucaaggaaaaaagaugauccggccucagcccauggagcacaaauacucuuggaagucguggggcaaggccaaaauaaucggggcggauauucagaacaccacauuuaucauugacggaccagauacuccugaaugucccgacaaucagcgcgccuggaacaucugggagguggaggauuauggcuucgguauauuuaccacaaauauuugguugaagcucagagacagcuacacgcaaaugugcgaucacaggcugauguccgcugcaaucaaagacucaaaggccguccaugcugauaugggguauuggauugaaagugagaaaaacgaaaccuggaagcuagcccgugcaucuuucaucgaggugaagacuuguacauggccaaaaagccacacccugugguccaauggaguucucgaaucagagaugauaauccccaagauuuacggcgguccuaucagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagauuauccaugaaugguguugcagguccuguacucucccuccacugcgcuuccggggugaggaugggugcugguacggaauggagauaagacccgugaaagaaaaggaggaaaaccuugucaggaguaugguuagcgccggcucuggugagguggacuccuuuucacugggcauuuuguguguaaguaucaugaucgaagaggugaugcgcagccgauggucgcggaagaugcucaugacagggacccuggcugucuuccuacugcucgugaugggacaacugacauggaaugaccuuauucguuugugcaucaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccauuggucugagcuugguggccucaguugaacugccaaacaguuuagaggaacucggggacggacuggcuaugggcauaaugaugcuuaagcuguugacugaguuccagccccaccagcucuggaccacacugcuaucccugacuuuuaucaaaaccacgcuuucucucgauuacgcguggaagacaaccgccauggcacugagcauuguguccuuguucccgcuguguuuaucaacuacaagccagaaaaccacuuggcucccuguccugcuuggcaguuuugggugcaagccacugacaauguucuugaucaccgaaaauaagauuuggggaaggaaaucuuggccccucaacgaggguaucauggcuauaggcaucguauccauucugcuaagcucgcugcuuaagaaugacgugccucucgccgggccccugaucgccggaggcauguugauugcuuguuauguuaucucagguucuagugcagauuuaucccuggagaaagccgcggaagugagcugggagcaagaagcugagcauucugggacgagccacaacauacucgucgaagugcaggacgauggaacuaugaagauuaaagacgaggagcgagaugacacccugacaauccuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggauuuacagaauacuucaaaggggauuacugggucguucucaggucggcguggggguuuuccaggacggaguauuucauaccauguggcacgugacgcgcggcgcaguccucauguaucaggguaaacgguuggaaccuuccugggccucagugaagaaagaccugaucaguuacgggggaggcuggagauuccaaggcagcuggaauacaggggaggagguucaggugauugcggucgaacccggaaagaacccaaaaaaugugcagacuacccccgguacauuuaagaccccugagggcgaaguaggggcuaucgcccucgauuucaagccaggaacuuccggcucucccauugucaacagggaggguaaaaucguggggcuguacggaaauggcguugugaccacaucgggcacguaugucagcgcaauagcccaagcuaaggccucacaggaagggccucuuccggagaucgaggacgaaguguuuaaaaagcgaaaccugacuauuauggauuugcacccaggauccgguaaaacccggcgcuaccuacccgcaaucguuagagaggcuauuaagaggaagcugcggacacucaucuuagccccuacccgaguggucgcgagugaaauggccgaggcacugaaaggcaugccaauaagauaucagacuacagcugugaagucugaacauaccgggcgcgagauuguagaccuuaugugccacgccacguucacuaugaggcugcucagccccgugcguguuccuaauuacaacaugaucaucauggaugaggcucauuuuacagacccggcauccauugccgcccggggauauaucucaaccagagucggcaugggugaagcugcggcaauauucaugaccgccacucccccagggucuguggaggcuuuuccucagagcaaugccgugauucaagaugaagagagggacauccccgaacgcaguuggaacuccggauacgauuggauuacagacuucccaggcaaaaccgucugguuuguaccuagcaucaagucuggcaaugauauagcaaacuguuugcgaaaaaacgggaagagagugauucagcugucacggaagacauucgacacugaguaucagaaaacgaagaauaacgacugggauuacguugugaccacagacaucuccgagaugggagccaauuucagggcugaucgcgucaucgacccccguagaugccucaaaccagugauucugaaggaugguccggaacggguuauccuugcgggcccuaugcccgugacugucgccagugcagcucagaggcgcgggcgaauuggaagaaaccaaaauaaagagggcgaccaguacguguauaugggucagccacuaaacaaugaugaagaccacgcccauuggaccgaggcaaagaugcuguuggauaacauaaauacacccgaggggaucauuccugccuuauuugaaccagagcgggaaaagagcgcugccaucgacggcgaguacaggcugcgcggagaagcgagaaaaaccuucguagagcucaugaggcggggcgaucugcccguguggcuuucguauaagguugcaucugagggguuucaguacuccgaccgucgcuggugcuucgauggagaacgaaacaaucaaguccuggaggaaaacauggacguggagaucuggacuaaagaaggugagagaaagaaacucaggccucggugguuggacgcccgcacguauagcgauccgcuggcucuaagagaguuuaaggaauucgccgcuggcaggcggucagugaguggggaccugauucucgagauaggaaaacuuccacagcaccugaccuuacgagcacagaaugccuuggauaaccuggucaugcuccacaauucugaacagggcgguaaggcuuacagacaugccauggaggaacugcccgacacaaucgagacucuuaugcugcucgcauugauugcgguucugaccgggggcgugacauuauuuuuccuauccggaaagggccuggggaaaaccagcaucggacuccuuuguguaacugccucaagugcucuguuguggauggccagcguggagccucacuggauugcagcuuccaucauacuggaauuuuuccucaugguccugcuuauccccgagccagaucgccaaaggacaccucaggacaaccagcucgccuaugugguuauuggucuguuguuuaugauccugacgguggcagccaacgaaaugggcuuacuagagaccacuaagaaagaucuggggauuggacaugucgcugcggagaaucaccaacacgccacaaugcucgacguagaucuucggcccgcaucugcuuggacccuguacgccguggccaccacaguuaucacuccaaugaugcgucauacgauagaaaacaccacagcaaauauuagcuugacugcuaucgccaaccaggcggcuauucugaugggccucgacaaggguuggccuaucuccaaaauggauauaggggugccgcugcuugccuuaggcugcuacucacaggucaauccccugacccucacagcagccguguugaugcuggucgcucacuaugcaaucauuggaccaggccuacaggccaaggcgaccagagaggcucaaaagaggacugccgcagggaucaugaaaaacccuacgguggacggaauuguugccaucgaucuggaccccgugguauacgacgcuaaguucgaaaaacagcucggccagauaaugcuucugauuuuguguacaucucagauccugcucaugcgcaccacuugggcccugugcgagaguaucaccuuagcaacagguccacuuacuacccugugggaagggucgccuggaaaguuuuggaauacaacgauugcugugagcauggccaacaucuuccggggcuccuaucucgcgggugccggccuagcauucucucugaugaaaucauuggggggaggccgaagagggaccggagcucaaggcgagacucugggugagaaguggaagaggcagcucaaucagcuuagcaaauccgaauuuaacacauacaagcgcagugggauaauggaggucgaucggucugaagccaaagagggacugaagagaggcgaaaccacuaaacaugcaguuagccgugguacagcuaaguugaggugguucguggagcggaaucuggucaagcccgagggcaaagugauugaccucggguguggacgcggcggguggucauauuacugcgccggauuaaagaaaguaaccgaagugaagggcuauacgaaaggugggccgggacacgaggaaccaaucccuauggccaccuacggcuggaaccugguuaagcuucauuccggcaaagauguguuuuucaugcccccagagaagugugacacacugcuaugcgauauuggggaaaguagccccaauccuacuaucgaggagggacgaacccucagaguccugaagaugguggaaccgugguugagggguaaccaguuuuguauaaaaauccugaaucccuacaugccaucugucguggaggcgcucgaacaaaugcagcggaagcacggcgggaugcuuguucgcaacccucuguccagaaauucaacacacgagauguauuggguaagcugcggaacuggcaacauugugucggcugucaacaugaccucuaggauguuacugaaucgauucacaauggcacaucggaaacccaccuacgagcgugacguggauuugggugccgggacuagacacguugcuguggaaccugaggucgccaaccucgacaucauuggacagcgcaucgaaaauauuaagaacgagcauaaaaguacguggcacuaugaugaagacaauccauacaagacaugggcauaucacggcuccuacgaggugaagcccagcggcucagccuccucuaugguaaacggggugguuaggcugcuaaccaaaccuugggaugucaucccaauggugacucaaauagcuaugaccgacacaacgcccuuuggacagcagcggguguucaaggagaaagucgacaccagaacuccgcgcgcgaagagggguacaacccagauuauggaaguuacugccaaauggcuuuggggcuuucugagccgaaauaagaagccucggaucuguacaagagaggaauucaccaggaaagugcgcaguaacgcagcuaucggggccguauuuguggaugagaaucaauggaacuccgcaaaggaagccgucgaggacgagcguuucugggaucucgugcaucgggaaagagagcugcacaaacagggaaagugcgcuacaugcguuuauaauaugaugggcaaaagggaaaagaaguugggugaguuugggaaagccaagggaagccgcgcgauuugguacauguggcugggcgcacgauuccucgaauucgaggcccuuggcuuuaugaacgaggaccauugguucucucgggaaaauucacugagugggguggagggagaagguuuacacaaacugggcuacauauugagagauaucuccaagauuccagggggaaacauguaugcugacgauacugccggcugggacaccaggaucacggaggaugaccuccagaaugaggcaaaaauuaccgaaaucauggagcccgaacaugcucugcuagccacaagcauauuuaagcuuacuuaccagaacaaagucgugcgcguacaaagaccugcuaagaacgguaccguuauggaugugaucucucggagggaccagcgugggucgggacaggucggcacauauggccugaauacuuucaccaacauggaggugcagcucauucgacaaauggaaucagaggggaucuuucugccaagcgaguuggaaacgcccaauuuagccgagcgcgugcuggauuggcucgaaaagcacggagcagagagacuuaaacggauggcgauuuccggugacgacugugucguuaagccgaucgaugacagguucgccacagcucugaccgcccuaaacgauaugggcaaagugcgcaaggacauaccucagugggaacccaguaaaggguggaaugauuggcagcagguaccauuuugcucucaccauuuccaccaacugauuaugaaggacggaagagagaucguggucccuugucggaaccaggaugagcucgugggcagggcacgaguuagccagggugcugggugguccuugcgugaaacugccugccugggaaagucauacgcacaaauguggcagcuuauguauuuucauagacgcgaccugcggcucgccgcgaaugcuaucuguagugccgugcccgucgauugggugccaacaucuaggaccacuuggagcauucacgcacaccaucaguggaugaccacagaggacauguuauccguauggaacagaguuuggauagaagagaaucccuggauggaagauaaaacgcacgugucaagcugggaggaggucccuuaccugggcaagcgcgaagaccaguggugcggcucuuugaucgggcugaccgcccgggcuacuugggccacaaacauucaaguggcaaucaaucagguuaggcgacucauuggaaacgagaauuaucuugacuacaugaccuccaugaaaagauucaagaacgaaagugauccagagggugcucugugguga

SEQ ID NO: 13384 - RNA, 9879 nt, Artificial Sequence
  derived and/or modified CDS sequence (opt3) from DENV-1__KJ189337__SS-prME
agcgugaccaugcugcucaugcuucugcccacagcauuggcuuuccacuuaacuacgaggggaggggagccucauaugaucgucuccaagcaggaaaggggaaaaucucuguuauuuaagaccucagccgguguuaacaugugcacccucauugccauggaccugggagagcuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacuuuggauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagauuuggaauaggcaggaucuccuggugacuuucaaaacagcucacgccaagaagcaagaaguaguuguguuagguagccaggagggggcuaugcacaccgcccugacaggcgcaacugaaauacagaccaguggaacgaccacaaucuuugccggccaucuaaaaugccggcucaagauggacaaacugacucuuaaggggaccucuuaugucauguguacaggauccuucaaauuggagaaggaaguggcugagacucagcacgguaccguccuggugcaaguuaaguacgagggcacggaugcgccuugcaaaauuccauucagcacacaggacgaaaagggggugacccagaacggacgucucaucacugcaaaucccauaguaacagauaaagagaagccugucaacauugaaaccgagccacccuuuggcgagucguauaucgugguuggugccggggaaaaagcucugaaacuuucuugguucaagaaaggcuccucaaucggaaagauguuugaggccacugcacgcggcgccagaaggauggcuauucugggggacaccgccugggauuucggaaguaucgguggcguguuuacaagcgucgggaaauuggugcaucagguauucggaacggcauacggcgugcucuuuuccgguguuucuuggaccaugaagauugggauaggcauccuguuaacuuggcugggacuaaauagccggucaacaagucucuccaugaccuguauugcggucggcauggugacacuguaccuuggggugaugguccaagcugacagcggaugcguuaucaacuggaaaggccgagaauugaagugugguucugggaucuucgugacuaacgaggugcacaccuggacggaacaguauaaguuucaggccgauucaccgaaacgccugagugcagccauuggaaaggcuugggaggagggcguaugcgguauaagaagcgccacaaggcucgaaaauaucauguggaaacagauuuccaacgagcugaaucauaucuuacuggaaaacgacaugaaguucaccgucgugguuggcgacgcaaaugggauucuugcucaaggcaagaagaugauccggccucagcccauggagcacaaauacucuuggaagucguggggcaaggccaaaauaaucggggcggauauucagaacacuaccuuuaucauugacggaccagauacaccugaaugucccgacaaucagcgcgccuggaacaucugggagguggaggauuauggcuucgguauauuuacuaccaauauuugguugaagcucagagacagcuacacacaaaugugcgaucacaggcugauguccgcugcaaucaaagacucaaaggccguccaugcugauaugggguauuggauugaaagugagaaaaacgaaacguggaagcuagcccgugcaucuuucaucgaggugaagaccuguacuuggccaaaaagccacacacugugguccaauggaguucucgaaucagagaugauaauccccaagauuuacggcgguccuaucagccagcauaacuaucggccaggcuacuucacccagacugcggggccguggcaccugggaaaacuugaguuggacuuugaucugugcgaaggcacaaccgugguagucgacgagcacugcgggaaucgaggacccucuuuaagaacgacuaccgugacaggcaagauuauccaugaaugguguugcagguccuguacccucccuccacugcgcuuccggggugaggaugggugcugguacggaauggagauaagacccgugaaagaaaaggaggaaaaccuugucaggaguaugguuagcgccggcucuggugagguggacuccuuuucacugggcauuuugugugcuaguaucaugaucgaagagguaaugcgcagccgauggucgcggaagaugcucaugacugggacacuggccguguuccuacugcucauuaugggacaacugaccuggaaugaccuuauccguuugugcauuauggucggcgcaaacgcuuccgauagaauggggaugggaacaacuuaucuggccuuaauggcaaccuuuaaaaugaggccuauguucgccgugggccuccuguuucgccggcuuacgucuagagagguucugcuacucacaauaggucugagcuugguggcuucagucgaacugccaaacaguuuagaggaacucggggacggacuggcgaugggcaucaugaugcuuaagcuguugaccgaguuccagccccaccagcucuggacuacccugcuaucccugacauuuauuaaaacuacccuuucucucgauuacgccuggaagacgacagcaauggcucugagcaucguguccuuguucccgcuguguuuaucaaccacuagccagaaaacaaccuggcucccuguucugcuuggcaguuuugggugcaagccacugacuauguucuugauuacagaaaauaagaucuggggaaggaaaucuuggccccucaacgaggguauaauggccaucggcauuguguccauccugcuaagcucgcugcuuaagaaugacgucccucucgccgggccccugauugcuggaggcauguugaucgcauguuauguaauaucagguucuagugccgauuuaucccuggagaaagcggcugaagugagcugggagcaagaagccgagcauucugggaccagccacaacauucucguugaagugcaggacgauggaacgaugaagaucaaagacgaggagcgagaugacacucugaccauccuucugaaggcaacauugcuagccgucuccggcguguacccaaugucaauuccugcuacccuguuuguaugguauuucuggcagaaacgcaagcagcggaguggcgugcucugggauacacccagcccaccggaagucgagagagcaguucuggacgaugggauauacaggauccuucaacguggauuacugggucgcucucaggugggcgugggggucuuccaggacggaguguuucauacuauguggcacguuacccggggcgccguacucauguaucaggguaagagauuggaaccuuccugggcgucagugaaaaaggaccugauuaguuacgggggaggcuggagguuccaaggcagcuggaauacgggggaggagguccaggugaucgcuguugaacccggcaagaacccaaagaaugugcagacaacucccgguaccuuuaaaacaccugagggcgaagucggggccauugcacucgauuucaagccaggaaccuccggcucucccaucgugaaccgagaggguaagauaguagggcuguacggaaauggcgucgugacuaccucgggcacauauguuagcgccaucgcucaagccaaagcaucacaggaagggccucuuccggagauugaggacgaaguguuuaagaaacggaaccugacgaucauggauuugcacccaggauccgguaagacucgcagauaccuacccgcuauugucagggaggccaucaaacggaagcugcgaacccucauauuagcgccuacaagagugguugccagugaaauggcagaggcucugaagggcaugccaauucgcuaucagaccacugccgugaaaucugaacauacagggagggagaucgucgaccuuaugugccacgcuaccuucacgaugcgucugcucagccccgugcggguaccuaauuacaacaugaucauuauggaugaggcacauuuuacugacccggccuccaucgccgcuagaggauauauaucaacaagggugggcaugggugaagcggcagccauuuucaugaccgcuacacccccagggucuguugaggccuuuccucagagcaaugcagucauccaagaugaagaacgcgacauucccgaacgaaguuggaacuccggauacgauuggaucacugacuucccaggcaagacagugugguuugugccuagcauaaaaucuggcaaugauauugccaacuguuugagaaagaacgggaaacgggucauccagcugucaaggaagaccuucgacacagaguaucagaagacuaaaaauaacgacugggauuacguagugacgaccgacaucuccgagaugggagcuaauuuccgcgcggaucguguuauugaccccagacggugccucaagccagugauccugaaagaugguccggaaagggucauucuugccggcccuaugcccgugacaguugcaagugcugcccagcgccgagggagaauaggacggaaccaaaauaaggagggcgaccaguacguguauaugggucagccacuaaacaaugaugaagaccacgcacauuggacugaggccaaaaugcuguuggauaacaucaauacccccgaggggauuaucccugcuuuauuugaaccagagagggaaaagagcgccgcgaucgacggcgaguaccgccugagaggagaagcaaggaagacauucgucgagcucaugcggcguggcgaucugcccguguggcuuucguauaaaguagccucugagggguuucaguacuccgaccgccgauggugcuucgauggagaaagaaacaaucaagugcuggaggaaaacauggacguugagauuuggaccaaggaaggugagaggaaaaagcuccggccucgcugguuggacgcuagaacuuauagcgauccgcuggcccuaagggaguuuaaagaguucgcugcaggccggcgaucagucaguggggaccugauacucgagaucggaaaacuuccacagcaccugacguuaagagcccagaaugcuuuggauaaccuggugaugcuccacaauucugaacagggcgguaaagccuaccgccaugcaauggaggaacugcccgacaccauugagacacuuaugcugcucgcguugaucgccgugcugacugggggcgucaccuuauuuuuccuauccggaaagggccuggggaagacaagcauuggacuccuuuguguuaccgcuucaagugcccuguuguggauggcaagcguggagccucacuggaucgcugccuccauaauccuggaauuuuuccucaugguacugcuuauucccgagccagauaggcaacggacuccucaggacaaccagcucgcauauguggucaucggucuguuguuuaugauucugacaguggccgcuaacgaaaugggcuuacuagagacgaccaaaaaggaucuggggaucggacauguugcggccgagaaucaccaacacgcaacuaugcucgacguggaucuucgucccgcuucugccuggacacuguacgccgucgcaaccaccguaauaacaccaaugaugagacauacuauugaaaacacgaccgcuaauaucagcuugacagccauugcgaaccaggcugccauccugaugggccucgacaaagguuggccuauauccaagauggauaucggggugccgcugcuugcauuaggcugcuacucacagguuaauccccugacucucaccgccgcuguguugaugcuggucgcacacuaugccauuaucggaccaggccuacaggcgaaagcuacaagggaggcccaaaagcgcaccgcagccgggauuaugaagaacccuacuguggacggaaucgucgcuauagaucuggaccccgugguuuacgacgccaaauucgaaaagcagcucggccagauuaugcuucugaucuuguguacgucucagauccugcucaugcggacaaccugggcacugugcgagaguauuacuuuagcuaccgguccacuuacaacucugugggaagggucgccuggaaaauuuuggaauaccacaaucgccgugagcauggcgaacauauuccgaggcuccuaucucgccggugcaggccuagcuuucucucugaugaagucacuagggggaggcagaagggggacgggagcccaaggcgagacccugggugagaaauggaagcgccagcucaaucagcuuagcaaguccgaauuuaacacuuacaaacggagugggauuauggagguagauagaucugaagcaaaggagggacugaaacguggcgaaacaaccaagcaugcugugagcagggguacugccaaauugcggugguucgucgagcgcaaucugguuaagcccgagggcaaggugaucgaccucggguguggacgaggcggguggucauauuacugcgccggacugaaaaaggucacagaagugaaaggcuauaccaagggugggccgggacacgaggaaccaauuccuauggcgacguacggcuggaaccuaguaaaacuucauuccggcaaggauguguuuuucaugcccccagagaaaugugacacccugcuaugcgauaucggggaaaguagccccaauccuacaauagaggagggaagaacucucaggguucugaagaugguggaaccgugguugcgggguaaccaguuuuguaucaagauucugaaucccuacaugccaucugucguggagacccucgaacaaaugcagcgcaaacacggcgggaugcuugucagaaacccucuguccagaaauucaacacacgagauguauugggugagcugcggaacuggcaacaucguuucggcuguaaacaugaccucucgaauguuacugaaucgguucacaauggcacaucguaagcccaccuuugagagagacguggauuugggugccgggacucgccacgucgcuguggaaccugagguugccaaccucgacauuaucggacagaggauugaaaaugugaaaaacgagcauaagaguacguggcacuacgaugaagacaauccauauaaaacaugggcauaccacggcuccuaugaggucaagcccagcggcucagccuccucuauggugaacgggguagugcggcugcuaaccaagccuugggauguuaucccaauggucacucaaauagcuaugaccgacacaacgcccuucggacagcagagaguguuuaaagagaagguggacacccgcacuccgagggcgaaacgagguacaacccagauuauggaagucacugccaaguggcuuuggggcuuccugagccggaauaaaaagccuagaaucuguacaagggaggaauuuacccgcaagguucguaguaacgcagcuaucggggccguguucguagaugagaaucaauggaacuccgcaaaagaagccguggaggacgagcgguuuugggaucucguccauagagaaagggagcugcacaagcagggaaaaugcgcuacaugcguguacaauaugaugggcaagcgcgagaaaaaguugggugaguucgggaaggccaaaggaagccgagcgauuugguauauguggcugggcgcacgguuccucgaauuugaggcccuuggcuucaugaacgaggaccauugguuuucuagagaaaauucacugagugggguugagggagaagguuuacacaagcugggcuacauauugagggauaucuccaaaauuccagggggaaacauguacgcugacgauacugccggcugggacacccgcaucacggaggaugaccuccagaaugaggcaaagauuaccgauaucauggaacccgagcaugcucugcuagccacaagcauauucaaacuuacuuaucagaacaagguggucagagugcaacggccugcuaaaaacgguaccguaauggacguuaucucuaggcgugaucagcgagggucgggacaggugggcacauacggccugaauacuuuuaccaacauggaaguccagcucauucgccaaauggagucagaagggaucuuccugccaagcgaguuggagacgcccaauuuagccgaaagagugcuggacuggcucgagaagcacggagcagaacggcuuaagaggauggcgauuuccggugacgauuguguggucaaaccgaucgacgaucgcuuugccacagcucugaccgcccuaaacgacaugggcaagguuagaaaagauauaccucagugggagcccaguaagggguggaaugacuggcaacaggugccauucugcucucaccauuuucaccaacugauuaugaaagauggacgggaaaucguagugccuuguaggaaccaggacgagcucgucggccgagcacgugugagccagggugcugggugguccuugagagagacugccugccugggaaagucauaugcacaaauguggcagcuuauguacuuccaucgccgggaucugaggcucgccgcgaaugcuaucuguagugccguucccguggacugggucccaacaucuagaaccacuuggagcauucacgcacaccaucaguggaugaccacagaagauauguuauccguguggaaccgcguauggauagaggaaaaucccuggauggaggacaagacgcacguuucaagcugggaagaggugccuuaucugggcaaacgggaggaccaguggugcggcucuuugaucgggcugaccgccagggcuacuugggccacaaacauucaagucgcaaucaaucaggugcgaagacucauuggaaacgaaaauuaccuugauuauaugaccuccaugaagcgguuuaaaaacgagagugacccagaaggugcucugugguga

SEQ ID NO: 13385 - RNA, 9879 nt, Artificial Sequence
  derived and/or modified CDS sequence (opt3) from DENV-1__KJ189340__SS-prME
agcgugaccaugcugcucaugcuucugccaacagcauuggcuuuccacuuaacuacgcggggaggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuacaggauucuucaacgaggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaagaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaggcgggacguaugucucggcaaucgcccaagcuaaggccagccaggaaggaccucuuccggagauagaggacgaaguguuuaaaaagcgaaaccugacuaucauggauuugcacccagguucaggcaaaacccggcgcuaccuacccgcaauuguuagagaggcuaucaagaggaagcugcggacacucauuuuagccccuacccgaguggucgcguccgaaauggccgaggcacugaaagggaugccaaucagauaucagacuacagcugugaagagugaacauaccggacgcgagauaguagaccuuaugugccacgccacguucacuaugaggcugcucucucccgugcguguuccuaauuacaacaugauuaucauggaugaggcucauuuuacagacccggcaagcaucgccgcccggggcuauauuuccaccagagucgguaugggggaagcugcggcaaucuucaugaccgccacucccccaggaucaguggaggcuuuuccucagucuaaugccgugauacaagaugaagagagggacauucccgaacgcagcuggaacaguggcuacgauuggaucacagacuucccaggcaaaaccgucugguuuguaccuuccauuaagagcgggaaugauaucgcaaacuguuugagaaagaacggaaaaagagugauacagcugucucggaagacauucgacacugaguaucagaaaacgaagaauaacgacugggauuacguugugaccacagacauuucagagaugggugccaauuucagggcugaucgcgucaucgacccccguagaugccucaaaccagugauccugaaggauggcccggaacggguuauucuugcggggccuaugcccgugacugucgccuccgcagcucagaggcgcggacgaaucggcagaaaccaaaauaaagagggugaccaguacguguauauggggcagccacuaaacaaugaugaagaccacgcccauuggaccgaggcaaagaugcuguuggauaacauuaauacacccgagggcauaaucccugccuuauuugaaccagagcgggaaaagagugcugccauugacggagaguacaggcugcgcggcgaagcgagaaaaaccuucguagagcucaugaggagaggggaucugcccguguggcuuagcuauaagguugcaucggagggauuucaguacucugaccgucgcuggugcuucgauggugaacgaaacaaucaaguccuggaggaaaacauggacguggagaucuggacuaaagaaggcgagagaaagaaacucaggccucggugguuggacgcccgcacguauuccgauccgcuggcucuaagagaguuuaaggaguucgccgcugggaggcggagcgugucaggagaccugauccucgagauuggcaaacuuccacagcaccugaccuuacgagcacagaaugccuuggauaaccuggucaugcuccacaauagugaacagggugggaaggcuuacagacaugccauggaggaacugcccgacacaauagagacucuuaugcugcucgcauugaucgcgguucugaccggcggagugacauuauuuuuccuaucuggcaaggggcugggaaaaaccuccauuggucuccuuuguguaacugccagcucagcucuguuguggauggccaguguggagccucacuggaucgcagcuagcauuauccuggaauuuuuccucaugguccugcuuauacccgagccagaucgccaaaggacaccucaggacaaccagcucgccuaugugguuaucggccuguuguuuaugauucugacgguggcagccaacgaaaugggguuacuagagaccacuaagaaagaucugggaaucggccaugucgcugcggagaaucaccaacacgccacaaugcucgacguagaucuucggcccgcauccgcuuggacccuguacgccguggccaccacaguuauuacuccaaugaugcgucauacgaucgaaaacaccacagcaaauauaucuuugacugcuauugccaaccaggcggcuauccugaugggucucgacaagggguggccuauuagcaaaauggauaucggcgugccgcugcuugccuuaggaugcuacucccaggucaauccccugacccucacagcagccguguugaugcuggucgcucacuaugcaauaaucggcccagggcuacaggccaaggcgaccagagaggcucaaaagaggacugccgcaggaauuaugaaaaacccuacgguggacggcaucguugccauugaucuggaccccgugguauacgacgcuaaguucgaaaaacagcucggucagaucaugcuucugauauuguguacaucacagauucugcucaugcgcaccacuugggcccugugcgagucuaucaccuuagcaacagggccacuuacuacccugugggaaggaaguccuggcaaguuuuggaauacaacgaucgcugugucgauggccaacauuuuccgggguagcuaucucgcgggcgccgggcuagcauucucccugaugaaaucuuugggaggcgggcgaagaggaaccggcgcucaaggugagacucugggggagaaguggaagaggcagcucaaucagcuuucaaaaagcgaauuuaacacauacaagcgcuccggaaucauggaggucgaucggagugaagccaaagagggccugaagagaggugaaaccacuaaacaugcaguuucucguggcacagcuaaguugaggugguucguggagcggaaucuggucaagcccgaggggaaagugauagaccucggauguggccgcgggggauggagcuauuacugcgccggcuuaaagaaaguaaccgaagugaaggguuauacgaaagggggaccgggccacgaggaaccaauuccuauggccaccuacggcuggaaccugguuaaacuucauucagggaaagauguguuuuucaugcccccagagaagugugacacacugcuaugcgauaucggagaauccagucccaauccuacuauugaggagggucgaacccucagaguccugaagaugguggaaccgugguugaggggcaaccaguuuuguaucaaaauacugaaucccuacaugccaagcgucguggaggcgcucgaacaaaugcagcggaagcacgggggaaugcuuguucgcaacccucugucuagaaauuccacacacgagauguauuggguaucaugcggcacugguaacaucgugagcgcugucaacaugaccucgaggauguuacugaaucgauucacaauggcacaucggaaacccaccuacgagcgugacguggauuugggggccggaacuagacacguugcuguggaaccugaggucgccaaccucgacauuaucggccagcgcauugaaaauaucaagaacgagcauaaaucuacguggcacuaugaugaagacaauccauacaagacaugggcauaucacggcaguuacgaggugaagcccuccgggagcgccucauccaugguaaacggagugguuaggcugcuaaccaaaccuugggaugucauuccaauggugacucaaaucgcuaugaccgacacaacgcccuuuggucagcagcggguguucaaggagaaagucgacaccagaacuccgaaggcgaaacgcggcacaacccagauaauggaaguuacugccaaguggcuuuggggguuucugucuaggaauaagaaaccucgaauuuguacacgggaggaguucaccagaaaggugaggagcaacgcagcuaucggagccguauuuguggaugagaaucaauggaacagugcaaaagaagccgucgaggacgagcgcuucugggaucucgugcaucgugaacgggagcugcacaagcagggcaaaugcgcuacaugcguuuauaauaugauggguaagagagaaaagaaauugggggaguuuggaaaggccaaaggcuccagggcgaucugguacauguggcugggcgcacgcuuccucgaguucgaggcccuuggguuuaugaacgaggaccauugguucagccgagaaaauucucugucaggaguggagggugaaggcuuacacaagcugggguacauuuugcgggauauaaguaaaaucccaggaggcaacauguaugcugacgauacugccgguugggacaccagaauuacggaggaugaccuccagaaugaggcaaagaucaccgaaauuauggagcccgaacaugcucugcuagccacauccaucuuuaaacuuacuuaccagaacaaggucgugaggguacaacgcccugcuaagaacgggaccguuauggaugugauaagcagacgggaccagaggggaucuggccaggucggcacauaugggcugaauacuuucaccaacauggaggugcagcucauccgucaaauggaaucggagggaauuuuucugccaucagaguuggaaacgcccaauuuagccgagcgagugcuggauuggcucgaaaaacacggugcagagcgccuuaagagaauggcgaucagcggcgacgacugugucguuaaaccgauugaugaccgguucgccacagcucugaccgcccuaaacgauauggggaaggugaggaaagacaucccucagugggaacccuccaagggauggaaugauuggcagcagguaccauuuugcagucaccauuuccaccaacugauaaugaaggacggccgcgagauuguggucccuuguagaaaccaggaugagcucgugggucgggcaaggguuucucagggggcuggauggagcuugcgagaaacugccugccugggcaaauccuacgcacaaauguggcagcuuauguauuuucaucguagagaccugcgccucgccgcgaaugcuaucuguucagccgugcccgucgauugggugccaacaagucggaccacuuggucuauccacgcacaccaucaguggaugaccacagaggacauguuaagcguauggaacaggguuuggauugaagagaaucccuggauggaagauaagacgcacguguccucaugggaggaggucccuuaccugggcaaaagagaagaccaguggugcgggagcuugauaggacugaccgcccgcgcuacuugggccacaaacauccaaguggcaauuaaucagguucggaggcucaucgguaacgagaauuaucuugacuacaugaccucuaugaagcgauucaaaaacgaauccgauccagagggcgcucugugguga

SEQ ID NO: 13386 - RNA, 9879 nt, Artificial Sequence
  derived and/or modified CDS sequence (opt3) from DENV-1__KJ189341__SS-prME
agcgugacaaugcugcucaugcuucugcccacagccuuggcuuuccacuuaacuacgagaggaggggaaccucauaugaucgucuccaagcaggaaaggggaaaaucucuguuauuuaagaccucagcugguguuaauaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggaggccaccggcgcgagaagcgaagcguggcccuggcaccccaugucgguuuggggcucgagacucguaccgaaacauggauguccucugagggagccuggaaacagauccagagaguggaaacuugggcucugaggcacccuggcuucaccguuauugcacuguuucucgcccaugcuaucggcacaucgauuacccaaaaggggaucauauucaucuuacugaugcuugugacgccaucaauggccaugcggugcgucggaauugguaaucgcgacuuuguggagggcuugagcggggcgacuuggguagauguugugcuggagcacggaaguugugucacaaccauggcaaagaauaaacccacucuagacaucgaacuccugaagacagaggugaccaacccugccgugcuuagaaaacugugcauugaagcuaagaucuccaauacgaccacagauucuagguguccaacucagggcgaggccaccuuggucgaagaacaggacgcaaacuucguuugccggcgcacauuuguggaucgagguugggggaauggauguggccucuucggcaaagggagccuguuaacuugcgcuaaguuuaagugcguaaccaaacuggagggaaagauagugcaguacgaaaaccucaaauauuccgucauugugacaguucacaccggugaccaacaucaggugggcaaugagacuacggaacacgggacaaucgccaccauuacuccccaggcgccuaccucagagauccagcuuacagauuacggagcccugaccuuggacuguaguccaagaacuggccuagacuucaacgaaaugguccugcucacaaugaaggagaaaagcuggcuggugcauaagcaaugguuucuugaucugccguugcccuggacgucuggugcauccaccucacaggagacuuggaauaggcaggaccuccugguaacauucaaaaccgcucacgccaagaagcaagaaguuguggucuuagggagccaggagggcgcuaugcacacagcccugacuggagcaaccgaaauccagacgaguggcaccacaacuauuuuugccgggcaucuaaaaugccggcucaagauggauaaacugacccuuaagggaacaucuuaugugauguguacugguccuuucaaauuggagaaggaagucgcugagacccagcacggcacggugcugguucaagugaaguacgaggggacagacgcgccaugcaaaauacccuucuccacccaggaugaaaagggaguaacucagaacggccgucucaucacagcaaauccuauugucaccgacaaagagaagccagugaacaucgaaacugagcccccguuuggugagagcuauauaguugugggggccggcgaaaaagcucugaaacuuucgugguucaagaaaggaucuuccauuggcaagauguuugaggccaccgcacgcggggccagaaggauggcuauccugggagauacagccugggacuucgguucaaucggcggggucuuuacgagugugggaaaauugguacaucagguguucggcaccgcauacgguguucucuuuagcggggucuccuggacuaugaagauuggcaucggcauucuguuaacauggcugggccuaaauucucggagcaccucacucaguaugacauguauagugguggggaucgucacucuguaccuuggaguuauggugcaagcggauuccggcugcgugauuaacuggaaaggucgagaauugaagugugggagcggaaucuucguaaccaacgagguccacacguggacagaacaguauaaguuucaggcugacucuccuaaacgccugucagccgcaaucggcaaggccugggaggagggugugugcggcauuagaagugcuaccaggcucgaaaauauaauguggaaacagaucagcaacgagcugaaucauauuuuacuggaaaacgauaugaaguucacuguuguggucggggacgccaauggaauccuugcacaaggcaaaaagaugauucggccccagccaauggagcacaaauacuccuggaagucuugggggaaggcuaaaaucauaggagccgacacccagaacacaacuuuuaucauugauggcccugacacccccgaauguccagauaaucagcgcgcguggaacaucugggagguggaggacuaugguuucgggauuuuuacaacgaauaucugguugaagcucagagauucguacacccaaaugugcgaccacaggcugaugagcgccgcuauaaaagauuccaaggcaguucaugccgacaugggauauuggauugaaucagagaaaaacgaaacuuggaagcuagcucgugccaguuucaucgaggugaagacauguaccuggcccaaaucucacacucuguggagcaauggcguacucgaauccgagaugauuaucccuaagauauacgguggcccaaucucacagcauaacuaucggccgggguacuucacacagaccgcaggacccuggcaccugggcaaacuugaguuggauuuugaccugugcgaagggacgacugucgugguggaugagcacugcggaaaucgaggcccuagcuuaagaaccacaaccgucacugguaagauuauccaugaaugguguugcaggucuuguacacucccaccccugcgcuucagaggggaagacggaugcugguacggcauggagauuagaccuguuaaagaaaaggaggaaaaccuugugagguccaugguaagugcggguagcggcgagguggauucuuuuucccuggggaucuugugugccucaauaaugauugaagaggucaugcgcagucgauggagccggaagaugcucaugaccggaacacuggcuguguuccuacugcucaucaugggccaacugacuuggaaagaccuuauccguuugugcauuaugguuggggccaaugcaucggacagaaugggaaugggcaccacguaucuggcuuuaauggccacauuuaagaugaggccaauguucgcagugggucuccuguuucgccggcuuaccuccagagagguccugcuacucacuaucgggcugucuuugguggccagcguugaacugcccaacucauuagaggaacucggagauggccuggcuaugggcauuaugaugcuuaaacuguugaccgaguuccagccgcaccagcucuggacaacucugcuaagucugaccuuuauaaagacgacacuuucccucgacuacgcguggaaaaccacugccauggcacugucuaucgugagcuuguucccucuguguuuauccacaaccucacagaagacuacauggcucccaguccugcuugggagcuuuggaugcaagcccaguaccauguuccugauuacggaaaacaaaaucugggguaggaagucuuggccuuugaaugagggcauuauggcuaucgggauaguauccauccuccugagcucgcuacugaaaaacgaugugccccuugccggaccacucauugccggcgguaugcugaucgcuuguuauguuauuucagggucuagugcagacuuguccuuagagaaggccgcggaagugagcugggagcaagaagcugagcauucuggaacuagccacaauauccuggucgaagugcaggaugacggcaccaugaaaauaaaggaugaggagcgagacgauacacucaccauucugcuuaaagccacacuguuggcaguauccggcguguacccuaugucaauccccgccacucuauuugucugguauuucuggcagaagaagaaacagcgcagugggguucugugggacaccccaagcccgccugaaguggagcgggcugugcucgaugacggaaucuaccggauucugcaaaggggucuuuuaggccguucucaggucggggugggaguuuuccaggauggcguauuucauacgauguggcacgugacacgcggugcaguccugauguaucaggggaagcggcucgaacccuccugggccucagugaaaaaggacuugauaaguuacggaggcggcuggagauuccaagggagcuggaacacuggagaggagguucaggugaucgcggucgaaccagguaaaaaucccaagaacgugcagaccacaccuggcaccuuuaagacuccagagggggaaguaggagcuauugcccuggacuucaaacccggcaccuccgguucuccuaucgucaauagggaggggaagauugugggacucuacggcaacggcguugugacaacgucggggacuuaugucagcgcaaucgcccaagcuaaagccucacaggaaggaccgcugccagagauagaggaugaaguguuuaagaaacgaaaucuuaccaucauggaccugcaccccgguuccggcaagacacggcgcuacuugccugcaauuguuagagaggcuaucaagaggaaacuacggacccugauucucgccccaacucgaguggucgcgagugaaauggccgaggcauuaaaggggaugcccaucagauaucagacaaccgcugugaaaucugaacauacgggacgcgagauaguagaucugaugugccacgccacuuucacaaugaggcuucugagcccugugcguguuccgaacuacaauaugauuaucauggacgaggcucauuuuaccgaucccgcauccaucgccgcccggggcuauauuucaaccagagucgguaugggggaagcugcggcaaucuucaugacugccacaccaccuggaucuguggaggcuuuuccccagagcaacgccgugauacaagacgaagagagggauauuccagaacgcaguuggaacuccggcuacgacuggaucaccgauuucccuggcaagacagucugguuuguacccagcauuaaaucugggaacgacaucgcaaauugucuccgaaagaacggaaagagagugauacaguugucacggaaaacuuucgauacggaguaucagaagaccaaaaacaaugacugggacuacguugugacaacugauauuuccgagaugggugccaacuucagggcugaccgcgucaucgauccacguagaugccugaagccggugauccucaaagacggcccugaacggguuauucuggcggggcccaugccagugaccgucgccagugcagcucagaggcgcggacgaaucggcagaaaucaaaacaaggagggugaucaguacguguauauggggcagccccuuaauaacgacgaagaucacgcccauuggacagaggcaaagaugcuacuggacaauauuaacaccccugagggcauaaucccagccuuguuugaacccgagcgggagaaaagcgcugccauugauggagaguacagguuacgcggcgaagcgagaaagacuuucguagagcugaugaggagaggggaccucccuguguggcugucguauaaaguugcaucugagggaauccaguacuccgaucgucgcuggugcuuugacggugaacgaaauaaccaaguccuugaggaaaauauggauguggagaucuggacgaaggaaggcgagaggaagaagcugaggccgcgguggcucgacgcccgcaccuauagcgacccauuggcucugagagaguucaaagaauuugccgcugggaggcggucagugaguggagaucuaauucuggagauaggcaagcucccccagcaccuuacacugcgagcacagaacgccuuagacaauuuggucaugcugcacaacucugaacagggugggaaggcuuacagacaugccauggaggaacucccugauacuaucgagacccugaugcuucuggcacucauugcgguuuugacaggcggagugacccuguucuuuuuauccggcaaagggcuaggaaagacuagcaucggucugcucuguguaacagccucaagugcacuucuguggauggccagcguggaguugcacuggauugcagcuuccaucauacuggaguucuuucucaugguccugcuuauccccgagccagaccgccaaaggacgccucaggauaaucagcucgccuaugugguuauuggccuguuguucaugauccugaccguggcagccaacgaaaugggguuacuagagacuaccaaaaaggaccugggaauuggccaugucgcugcggagaaccaccaacacgccaccaugcucgauguagaccuucggcccgcaucugcuuggacccuguacgccguggccacaacuguuaucacgccaaugaugcgucauaccauagaaaauacaacugcaaacauuagcuugaccgcuaucgccaaucaggcggcuauucugaugggucucgauaaaggguggccuaucuccaagauggacauaggcgugccgcugcuugccuuaggaugcuacucacaggucaacccccugacacucaccgcagccguguugaugcuggucgcucacuaugcaaucauuggcccagggcuacaggccaaggcgacuagagaggcucaaaaacggacggccgcaggaaucaugaagaauccuacaguggauggcauuguugccaucgaccuggaucccgugguauacgacgcuaaauuugaaaagcagcucggucagauaaugcuucugauuuuguguaccucucagauccugcucaugcgcacuaccugggcccugugcgagaguaucacauuagcaacugggccacuuaccacacugugggaaggaucgccuggcaaauucuggaacacgaccauugcugugagcauggccaauaucuuucgggguuccuaucucgcgggcgccgggcuagcauucucucugaugaagucauugggaggcgggcgaagaggaacuggcgcucaaggugagacacugggggagaaguggaaaaggcagcucaaccagcuuagcaaguccgaguucaauauauacaaacgcaguggaauuauggaggucgaccggucugaagccaaggagggccugaaaagaggugaaaccacuaagcaugcaguuagccguggcacagcuaaguugaggugguuuguggagcggaaccuggucaaacccgaggggaaggugaucgaucucggauguggccgcgggggauggucauauuacugcgccggccuaaagaagguaaccgaagugaaagguuauacgaaagggggaccgggccacgaggaaccaauuccuauggccaccuacggcuggaaucugguuaaacuucauuccgggaaggacguguucuuuaugcccccagagaagugugauacacugcuaugcgacaucggagaaaguagccccaacccuacuauagaggagggucgaacccucagaguccugaaaaugguggaaccgugguugaggggcaaucaguucuguaucaagauucugaaccccuacaugccaucugucguggagacacucgaacaaaugcagcggaaacacgggggaaugcuuguucgcaauccucuguccagaaacucaacucacgagauguauuggguaagcugcggcaccgguaauaucgugucggcggucaacaugacaucuaggauguuacugaaccgauuuaccauggcucaucggaagcccacuuacgagcgugauguggacuugggggcaggaacgagacacguugccguggaaccugaggucgcuaaucucgauauuaucggccagcgcauugaaaacaucaaaaaugagcauaagaguacauggcacuaugacgaagauaacccauacaagaccugggccuaucacggcuccuacgaggugaaacccagcgggucagcauccucuaugguaaauggagugguuaggcugcuaacuaagccuugggacgucauaccaauggugacccaaauugccaugacagauacgacccccuucggucagcagcggguguuuaaagagaaggucgacacuagaacaccgcgcgcuaaaaggggcaccacucagaucauggaaguuacagcgaaguggcuuuggggguuccugagccgaaacaagaaaccucggaucuguaccagagaggaauuuacaaggaaggugcgcaguaaugccgcaauuggagcuguauucguggacgagaaccaauggaacuccgccaaagaagcagucgaggaugagcguuuuugggaccucgugcaucgggaaagagagcugcacaagcagggcaaaugcgccacuugcguuuauaacaugauggguaagagggaaaagaaauugggggaguucggaaaggcuaaaggcagccgcgccauaugguacauguggcugggcgcgcgauuucucgaguucgaggcacuuggguucaugaaugaggaucauugguuuucucgggaaaacucacugaguggaguggagggugaaggcuuacacaagcugggguacaucuugagagacauuuccaaaaucccaggaggcaauauguaugccgaugacaccgcugguugggauacgaggauuaccgaggacgaucuccagaacgaggccaagaucacagacauaauggaacccgagcaugcacugcuagcuacuagcaucuucaaacuuaccuaccagaauaaggucgugcgcguacaaagaccugccaagaacgggacaguuauggaugugauuucucggagggaccagcguggaucgggccaggucggcacuuaugggcugaacaccuuuacgaauauggaagugcagcucauccgacaaauggagucagaaggaauuuuccugccaagcgaguuggagacacccaacuuagcugaacgcgugcuggauuggcucgagaaacacggugccgaaagacuuaagcggauggcaaucuccggcgacgacugugucguuaaaccgauagaugacagguuugcgaccgcccugacugcucuaaaugauauggggaaggugcgcaaagacauuccucagugggagcccaguaagggauggaacgauuggcagcagguaccauucugcucucaccauuuucaccaacugaucaugaaggacggcagagaaaucguggucccuugucggaaucaggaugagcucguggguagggcccgaguuagccagggggcaggaugguccuugcgugagacagcuugccugggcaaaucauacgcccaaauguggcagcuuauguauuuccauagacgcgaccugcggcucgcagccaacgcgauuuguagugcugugcccgucgauugggugccaaccucuaggacuaccuggagcauacacgcccaccaucaguggaugacaacggaagacauguuauccguauggaauagaguuuggaucgaggaaaaccccuggauggaggauaagacccacgugucaagcugggaagaggucccuuaccugggcaaacgcgaggaccaguggugcgggucuuugauuggacugacugcacgggccacaugggcuaccaauauccaaguggccauuaaccagguuaggcgacucaucgguaaugaaaacuaucuugacuacaugacuuccaugaagagauuuaaaaaugagagugauccagaaggcgcacugugguga

SEQ ID NO: 13387 - RNA, 9879 nt, Artificial Sequence
  derived and/or modified CDS sequence (opt3) from DENV-1__KJ189343__SS-prME
agcgugaccaugcugcucaugcuucugcccacagcauuggcuuuccacuuaacuacgagaggaggggagccucauaugauagucuccaagcaggaaaggggaaaaucucuguuguuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuacagcacuguuucucgcccaugcuauuggcaccucgaucacgcaaaagggcauuaucuucauauuacugaugcuugugacuccaucaauggccaugcggugcgucgggaucggaaaccgcgauuuuguggaggguuugagcggcgcgacauggguagacguugugcuggagcacgggaguugugucaccacuauggcaaagaauaaacccacacuagauauugaacuccugaagaccgaggugacgaacccugccauccuuagaaaacugugcauugaagcuaagaucuccaauaccacaacugacucuagguguccaacccagggagaggccacauugguggaagaacaggaugcaaacuucgucugccggcgcacuuuuguugaccgaggcugggguaauggguguggacucuucggcaaaggcagccuguuaaccugcgcuaaguuuaagugcgugacaaaacuggaggggaagauaguacaguacgaaaaccucaaauauuccgugauugucaccgugcacacuggagaucaacaucagguugguaaugagacgacagaacacggcaccaucgccacuauuaccccacaggcgccuacaucagagauccagcuuaccgacuacggggcccugacuuuggacuguaguccaagaacaggacuagauuucaacgaaauggugcugcucacgaugaaggagaaaagcuggcugguccauaagcaaugguuucuugaccugccguugcccuggaccucuggcgcauccacuucacaggagacauggaauaggcaggaucuccuggugaccuucaaaacagcucacgccaagaagcaagaaguaguuguguuagguagccaggagggggcuaugcacacugcccugaccggcgcaacggaaauccagaccaguggaacaacuaccauuuuugccggccaucuaaaaugccggcucaagauggacaaacugacacuuaaggggacuucuuaugucauguguaccggauccuucaaauuggagaaggaaguggcugagacgcagcacgguacaguccuggugcaaguuaaguacgagggcaccgaugcgccuugcaaaauaccauucagcacucaggacgaaaagggggugacacagaacggacgucucaucaccgcaaaucccauuguaacugauaaagagaagccugucaacaucgaaaccgagccacccuuuggcgagucguauauagugguuggugccggggaaaaagcucugaaacuuucuugguucaagaaaggcuccucaauuggaaagauguuugaggccacagcacgcggcgccagaaggauggcuauccugggggacacggccugggauuucggaaguaucgguggcguguuuaccagcgucgggaaauuggugcaucagguauucggaacugcauacggcgugcucuuuuccgguguuucuuggacaaugaagauugggaucggcauucuguuaaccuggcugggacuaaauagccggucaacaagucucuccaugacuuguauagcggucggcauggugacccuguaccuuggggugaugguccaagcugacagcggaugcguugugaacuggaaaggccgagaauugaagugugguucugggaucuucgugacgaacgagguacacacauggaccgaacaguauaaguuucaggccgauucaccgaaacgccugagugcagccauuggaaaggcuugggaggagggcgucugcgguaucagaagcgccacuaggcucgaaaauaucauguggaaacagauuuccaacgagcugaaucauauauuacuggaaaacgacaugaaguucaccgugguugugggcgacgcaaaugggauccuugcucaaggcaagaagaugauucggccucagcccauggagcacaaauacucuuggaagucguggggcaaggccaaaaucauuggggcggauauccagaacacaacuuuuauaaucgacggaccagauaccccugaaugucccgacaaucagcgcgccuggaacauuugggaggucgaggauuauggcuucgguaucuuuacaacgaauauuugguugaagcucagagacagcuacacccaaaugugcgaucacaggcugauguccgcugcaaucaaagacucaaaggccgugcaugcugauaugggguauuggauagaaagugagaaaaacgaaacuuggaagcuagcccgugcaucuuucauugagguuaagacauguaccuggccaaaaagccacacucugugguccaauggagugcucgaaucagagaugaucauucccaagaucuacggcgguccuauaagccagcauaacuaucggccaggcuacuucacacagaccgcggggccguggcaccugggaaaacuugaguuggacuuugaucugugcgaaggcacgacuguagucguggacgagcacugcgggaaucgaggacccucuuuaagaaccacaaccgugacuggcaagaucauucaugaaugguguugcagguccuguacacucccuccacugcgcuuccggggugaggaugggugcugguacggaauggagaucagacccgucaaagaaaaggaggaaaaccuuguuaggaguauggugagcgccggcucuggugagguagacuccuuuucacugggcauuuugugugcuaguaucaugauagaagaggugaugcgcagccgauggucgcggaagaugcucaugauugggacccuggccgucuuccuacugcucaucaugggacaacugacauggaaugaccuuauccguuugugcauuauggugggcgcaaacgcuuccgauagaauggggaugggaacuaccuaucuggccuuaauggcaacguuuaaaaugaggccuauguucgccguuggccuccuguuucgccggcuuacaucuagagaggugcugcuacucaccaucggucugagcuuggucgcuucaguggaacugccaaacaguuuagaggaacucggggacggacuggcgaugggcauuaugaugcuuaagcuguugacugaguuccagccccaccagcucuggaccacacugcuaucccugacuuuuauaaaaaccacgcuuucucucgauuacgccuggaagacaaccgcaauggcucugagcaucguuuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauuauggccaucggcauagucuccauccugcuaagcucgcugcuuaagaaugacguaccucucgccgggccccugauugcuggaggcauguugaucgcauguuaugugauuucagguucuagugccgauuuaucccuggagaaaacggcggaaguuagcugggagcaagaagcugagcauucugggacuagccacaacauccucguggaaguccaggacgauggaaccaugaagauaaaagacgaggagcgagaugacacacugaccauucuucugaaggccacauugcuagcaguguccggcguauacccaaugucaaucccugccacucuguuugugugguauuucuggcagaaaaagaagcagcgcaguggcguccucugggauacccccagcccaccggaaguugagcgggcugugcuggacgaugggaucuacaggauucuucaacgaggauuacugggucguucucaggugggcgucgggguguuccaggacggaguuuuucauacgauguggcacguaacacgcggcgcagugcucauguaucaggguaaacgguuggaaccuuccugggccucagucaagaaagaccugauaaguuacgggggaggcuggagauuccaaggcagcuggaauacuggggaggaggugcagguuaucgcgguggaacccggaaagaaccccaagaauguccagaccacacccgguaccuuuaagacuccugagggcgaagugggggcuauugcccucgauuucaagccaggaaccuccggcucucccaucguaaacagggaggguaaaauugucgggcuguacggaaauggcgugguuacaacgucgggcacuuaugugagcgcaaucgcccaagcuaaggccucacaggaagggccucuuccggagauagaggacgaagucuuuaaaaagcgaaaccugaccaucauggauuugcacccaggauccgguaaaacacggcgcuaccuacccgcaauugugagagaggcuaucaagaggaagcugcggacccucauuuuagccccuacucgaguuguggcgagugaaauggccgaggcacugaaaggcaugccaaucagauaucagacaaccgcugucaagucugaacauacggggcgcgagauaguggaccuuaugugccacgccacuuucacaaugaggcugcucagccccguacgugugccuaauuacaacaugauuaucauggaugaggcucauuuuaccgacccggcauccaucgccgcccggggauauauuucaaccagaguuggcaugggugaagcugcggcaaucuucaugacugccacacccccagggucugucgaggcuuuuccucagagcaaugccgugauacaagaugaagagagggacauucccgaacgcaguuggaacuccggauacgauuggaucaccgacuucccaggcaaaacagugugguuugucccuagcauuaagucuggcaaugauaucgcaaacuguuugagaaagaacgggaagagaguaauacagcugucacggaagacuuucgacacggaguaucagaaaaccaagaauaacgacugggauuacgugguuacaacugacauuuccgagaugggagccaauuucagggcugaucgcgugaucgacccccguagaugccucaaaccagucauccugaaggaugguccggaacgggugauucuugcgggcccuaugcccguuaccguggccagugcagcucagaggcgcgggcgaaucggaagaaaccaaaauaaagagggcgaccaguacgucuauaugggucagccacuaaacaaugaugaagaccacgcccauuggacagaggcaaagaugcuguuggauaacauuaauacccccgaggggauaaucccugccuuauuugaaccagagcgggaaaagagcgcugccauugacggcgaguacaggcugcgcggagaagcgagaaaaacuuucguggagcucaugaggcggggcgaucugcccguauggcuuucguauaagguggcaucugagggguuucaguacuccgaccgucgcuggugcuucgauggagaacgaaacaaucaaguucuggaggaaaacauggacgucgagaucuggacgaaagaaggugagagaaagaaacucaggccucggugguuggacgcccgcaccuauagcgauccgcuggcucuaagagaguuuaaggaguucgccgcuggcaggcggucagugaguggggaccugauccucgagauuggaaaacuuccacagcaccugacauuacgagcacagaaugccuuggauaaccuggcuaugcuccacaauucugaacagggcgguaaggccuacagacaugcaauggaggaacugcccgacacuauagagacccuuaugcugcucgcguugaucgccgugcugacagggggcgucaccuuauuuuuccuauccggaaagggccuggggaaaacuagcauuggacuccuuuguguuacagcuucaagugcccuguuguggauggcaagcguggagccucacuggaucgcugccuccauuauccuggaauuuuuccucaugguacugcuuauacccgagccagaucgccaaaggacgccucaggacaaccagcucgcauauguggucaucggucuguuguuuaugauucugaccguggccgcuaacgaaaugggcuuacuagagacuacaaagaaagaucuggggaucggacauguugcggccgagaaucaccaacacgcaaccaugcucgacguggaucuucggcccgcuucugccuggacccuguacgccgucgcaacaacuguaauuacgccaaugaugcgucauaccaucgaaaacacaacugcuaauaucagcuugaccgccauugcgaaccaggcugccauccugaugggccucgacaaggguuggccuauuuccaaaauggauaucggggugccgcugcuugcauuaggcugcuacucacagguuaauccccugacacucaccgccgcuguguugaugcuggucgcacacuaugccauaaucggaccaggccuacaggcgaaggcuacuagagaggcccaaaagaggacggcagccgggauuaugaaaaacccuacaguggacggaaucgucgcuauugaucuggaccccgugguuuacgacgccaaguucgaaaaacagcucggccagaucaugcuucugauauuguguaccucucagauucugcucaugcgcacuaccugggcacugugcgagaguaucacauuagcuacugguccacuuaccacacugugggaagggucgccuggaaaguuuuggaauacgaccaucgccgugagcauggcgaacauuuuccggggcuccuaucucgccggugcaggccuagcuuucucucugaugaaaucacuagggggaggccgaagagggacuggagcccaaggcgagacacugggugagaaguggaagaggcagcucaaucagcuuagcaaauccgaauuuaacaccuacaagcgcagugggaucauggagguagaucggucugaagcaaaagagggacugaagagaggcgaaacuacaaaacaugcugugagccgugguaccgccaaguugaggugguucgucgagcggaaucugguuaagcccgagggcaaagugauagaccucggguguggacgcggcggguggucauauuacugcgccggauuaaagaaagucacggaagugaagggcuauaccaaaggugggccgggacacgaggaaccaauuccuauggcgacauacggcuggaaccugguaaaacuucauuccggcaaagauguguuuuucaugcccccagagaagugugacacucugcuaugcgauaucggggaaaguagccccaauccuaccauugaggagggacgaacacucagaguucugaagaugguggaaccgugguugagggguaaccaguuuuguaucaaaauacugaaucccuacaugccaucugucguggagacucucgaacaaaugcagcggaagcacggcgggaugcuuguccgcaacccucuguccagaaauucaacccacgagauguauugggugagcugcggaacaggcaacaucguuucggcuguaaacaugaccucuaggauguuacugaaucgauucacuauggcacaucggaaacccacguuugagcgugacguggauuugggugccgggacaagacacgucgcuguggaaccugagguugccaaccucgacauuaucggacagcgcauugaaaauaucaagaacgagcauaaaaguaccuggcacuacgaugaagacaauccauauaagacuugggcauaccacggcuccuaugaggugaagcccagcggcucagccuccucuauggucaacggggugguaaggcugcuaaccaaaccuugggaugugauuccaaugguuacacaaaucgcuaugacggacaccacucccuucggacagcagcgggucuuuaaggagaaaguggacacaagaaccccgcgcgcgaagagggguacuacacagauaauggaagugaccgccaaauggcuuuggggcuuccugagccgaaauaagaagccucggauuuguacaagagaggaauuuacuaggaaaguccgcaguaacgcagcuaucggggccguuuucguggaugagaaucaauggaacuccgcaaaggaagccguagaggacgagcguuuuugggaucucgugcaucgggaaagagagcugcacaaacagggaaagugcgcuaccugcgucuacaauaugaugggcaaaagggaaaagaaguugggugaguucgggaaagccaagggaagccgcgcgaucugguauauguggcugggcgcacgauuccucgaauuugaggcccuuggcuucaugaacgaggaccauugguuuucucgggaaaauucacugagugggguggagggagaagguuuacacaaacugggcuacauuuugagagauauauccaagaucccagggggaaacauguacgcugacgauacggccggcugggacaccaggauuacagaggaugaccuccagaaugaggcaaaaaucacugauauuauggaacccgagcaugcucugcuagccaccagcaucuucaaacuuacauaucagaacaaaguugugcgcguccaaagaccugcuaagaacgguacugugauggacguaauaucucggagggaucagcgugggucgggacagguuggcaccuacggccugaauacguuuacaaacauggaagugcagcucauccgacaaauggagucagaagggauuuuccugccaagcgaguuggagacccccaauuuagccgaacgcguccuggacuggcucgagaagcacggagcagaaagacuuaaacggauggcgaucuccggugacgauuguguggugaagccgauugacgauagguuugccacugcucugacagcccuaaacgacaugggcaaaguccgcaaggauaucccucagugggagcccaguaaaggguggaaugacuggcagcagguuccauucugcucucaccauuuucaccaacugauaaugaaggauggaagagaaauugugguaccuugucggaaccaggacgagcucgugggcagggcacgagucagccagggugcugggugguccuugcgugagaccgccugccugggaaagucauaugcacaaauguggcagcuuauguacuuccauagacgcgaucugcggcucgccgcgaaugcuaucuguagugccgugcccguugacugggugccaacuucuaggaccacauggagcauccacgcacaccaucaguggaugacgaccgaagauauguuauccgucuggaacagaguguggauugaggaaaaucccuggauggaggacaaaacucacguaucaagcugggaagagguuccuuaucugggcaagcgcgaggaccaguggugcggcucuuugauagggcugacagcccgggcuaccugggccacuaacauccaaguggcaauuaaucaggucaggcgacucaucggaaacgaaaauuaccuugauuauaugacauccaugaaaagauuuaagaacgagagugacccagaaggugcucugugguga

SEQ ID NO: 13388 - RNA, 9879 nt, Artificial Sequence
  derived and/or modified CDS sequence (opt3) from DENV-1__KJ189344__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuacagcacuguuucucgcccaugcuauuggcaccucgaucacgcaaaagggcauuaucuucauauuacugaugcuugugacuccaucaauggccaugcggugcgucgggaucggaaaccgcgauuuuguggaggguuugagcggcgcgacauggguagacguugugcuggagcacgggaguugugucaccacuauggcaaagaauaaacccacacuagauauugaacuccugaagaccgaggugacgaacccugccauccuuagaaaacugugcauugaagcuaagaucuccaauaccacaacugacucuagguguccaacccagggagaggccacauugguggaagagcaggaugcaaacuucgucugccggcgcacuuuuguugaccgaggcugggguaauggguguggacucuucggcaaaggcagccuguuaaccugcgcuaaguuuaagugcgugacaaaacuggaggggaagauaguacaguacgaaaaccucaaauauuccgugauugucaccgugcacacuggagaucaacaucagguugguaaugagacgacagaacacggcaccaucgccacuauuaccccccaggcgccuacaucagagauccagcuuaccgacuacggggcccugacuuuggacuguaguccaagaacaggacuagauuucaacgaaauggugcugcucacgaugaaggagaaaagcuggcugguccauaagcaaugguuucuugaccugccguugcccuggaccucuggcgcauccacuucacaggagacauggaauaggcaggaucuccuggugaccuucaaaacagcucacgccaagaagcaagaaguaguuguguuagguagccaggagggggcuaugcacacugcccugaccggcgcaacggaaauccagaccaguggaacaacuaccauuuuugccggccaucuaaaaugccggcucaagauggacaaacugacacuuaaggggacuucuuaugucauguguaccggauccuucaaauuggagaaggaaguggcugagacgcagcacgguacaguccuggugcaaguuaaguacgagggcaccgaugcgccuugcaaaauaccauucagcacucaggacgaaaagggggugacacagaacggacgucucaucaccgcaaaucccauuguaacugauaaagagaagccugucaacaucgaaaccgagccacccuuuggcgagucguauauagugguuggugccggggaaaaagcucugaagcuuucuugguucaagaaaggcuccucaauuggaaagauguuugaggccacagcacgcggcgccagaaggauggcuauccugggggacacggccugggauuucggaaguaucgguggcguguuuaccagcgucgggaaauuggugcaucagguauucggaacugcauacggcgugcucuuuuccgguguuucuuggacaaugaagauugggaucggcauucuguuaaccuggcugggacuaaauagccggucaacaagucucuccaugacuuguauagcggucggcauggugacccuguaccuuggggugaugguccaagcugacagcggaugcguugugaacuggaaaggccgagaauugaagugugguucugggaucuucgugacgaacgagguacacacauggaccgaacaguauaaguuucaggccgauucaccgaaacgccugagugcagccauuggaaaggcuugggaggagggcgucugcgguaucagaagcgccacuaggcucgaaaauaucauguggaaacagauuuccaacgagcugaaucauauauuacuggaaaacgacaugaaguucaccgugguugugggcgacgcaaaugggauccuugcucaaggaaaaaagaugauucggccucagcccauggagcacaaauacucuuggaagucguggggcaaggccaaaaucauuggggcggauauccagaacacaacuuuuauaaucgacggaccagauaccccugaaugucccgacaaucagcgcgccuggaacauuugggaggucgaggauuauggcuucgguaucuuuacaacgaauauuugguugaagcucagagacagcuacacccaaaugugcgaucacaggcugauguccgcugcaaucaaagacucaaaggccgugcaugcugauaugggguauuggauagaaagugagaaaaacgaaacuuggaagcuagcccgugcaucuuucauugagguuaagacauguaccuggccaaaaagccacacucugugguccaauggagugcucgaaucagagaugaucauucccaagaucuacggcgguccuauaagccagcauaacuaucggccaggcuacuucacacagaccgcggggccguggcaccugggaaaacuugaguuggacuuugaucugugcgaaggcacgacuguagucguggacgagcacugcgggaaucgaggacccucuuuaagaaccacaaccgugacuggcaagaucauucaugaaugguguugcagguccuguacacucccuccacugcgcuuccggggugaggaugggugcugguacggaauggagaucagacccgucaaagaaaaggaggaaaaccuuguuaggaguauggugagcgccggcucuggugagguagacuccuuuucacugggcauuuugugugugaguaucaugauagaagaggucaugcgcagccgauggucgcggaagaugcucaugaccgggacacuggcuguguuccuacugcucguuaugggacaacugacuuggaaugaccuuauucguuugugcaucauggugggcgccaacgcauccgauagaauggggaugggaaccacguaucuggcuuuaauggccacauuuaaaaugaggccuauguucgcagucggccuccuguuucgccggcuuaccucuagagaggugcugcuacucacuaucggucugagcuugguugccucaguggaacugccaaacaguuuagaggaacucggggacggacuggcuaugggcauuaugaugcuuaagcuguugaccgaguuccagccccaccagcucuggacaacucugcuaucccugaccuuuaucaaaacgacacuuucucucgauuacgcguggaagaccacugccauggcacugagcauugucuccuuguucccgcuguguuuaucaacaaccagccagaaaacuacauggcucccuguacugcuuggcaguuuugggugcaagccacugaccauguucuugauaacggaaaauaagaucuggggaaggaaaucuuggccccucaacgaggguauuauggcuaucggcauuguguccauccugcuaagcucgcugcuuaagaaugacguuccucucgccgggccccugauagccggaggcauguugaucgcuuguuaugugauuucagguucuagugcagauuuaucccuggagaaagccgcggaagucagcugggagcaagaagcugagcauucugggacuagccacaacauccucguggaaguacaggacgauggaaccaugaagauuaaagacgaggagcgagaugacacacugaccauccuucugaaggccacauugcuagcaguguccggcgucuacccaaugucaauaccugccacucuguuuguuugguauuucuggcagaaaaagaagcagcgcaguggcgugcucugggauacccccagcccaccggaaguggagcgggcuguccuggacgaugggauuuacagaauccuucaaaggggauuacugggucguucucaggugggcguugggguauuccaggacggaguguuucauacgauguggcacgucacacgcggcgcagugcucauguaucaggguaaacgguuggaaccuuccugggccucaguuaagaaagaccugaucaguuacgggggaggcuggagauuccaaggcagcuggaauacuggggaggaggugcaggucauugcgguggaacccggaaagaacccaaaaaauguacagaccacacccgguaccuuuaagacuccugagggcgaagucggggcuauagcccucgauuucaagccaggaaccuccggcucucccaucgugaacagggaggguaaaauuguugggcuguacggaaauggcguggucacaacgucgggcacuuaugugagcgcaaucgcccaagcuaaggccucacaggaagggccucuuccggagauugaggacgaaguuuuuaaaaagcgaaaccugaccaucauggauuugcacccaggauccgguaaaacacggcgcuaccuacccgcaauagugagagaggcuaucaagaggaagcugcggacccucauuuuagccccuacucgagucguggcgagugaaauggccgaggcacugaaaggcaugccaaucagauaucagacaaccgcuguaaagucugaacauacggggcgcgagauuguggaccuuaugugccacgccacuuucacaaugaggcugcucagccccguucgugucccuaauuacaacaugaucauaauggaugaggcucauuuuaccgacccggcauccauugccgcccggggauauaucucaaccagagugggcaugggugaagcugcggcaaucuucaugacugccacacccccagggucuguggaggcuuuuccucagagcaaugccgucauucaagaugaagagagggacauccccgaacgcaguuggaacuccggauacgauuggauaaccgacuucccaggcaaaacaguaugguuugugccuagcauuaagucuggcaaugauaucgcaaacuguuugcgaaaaaacgggaagagaguuauucagcugucacggaagacuuucgacacggaguaucagaaaaccaagaauaacgacugggauuacguggucacaacugacaucuccgagaugggagccaauuucagggcugaucgcgugauagacccccguagaugccucaaaccaguuauucugaaggaugguccggaacgggugauccuugcgggcccuaugcccgucaccguggccagugcagcucagaggcgcgggcgaaucggaagaaaccaaaauaaagagggcgaccaguacguauauaugggucagccacuaaacaaugaugaagaccacgcccauuggacagaggcaaagaugcuguuggauaacauuaauacccccgaggggaucauuccugccuuauuugaaccagagcgggaaaagagcgcugccauagacggcgaguacaggcugcgcggagaagcgagaaaaacuuucguggagcucaugaggcggggcgaucugcccguuuggcuuucguauaaggucgcaucugagggguuucaguacuccgaccgucgcuggugcuucgauggagaacgaaacaaucaagugcuggaggaaaacauggacguggagaucuggacgaaagaaggugagagaaagaaacucaggccucggugguuggacgcccgcaccuauagcgauccgcuggcucuaagagaguuuaaggaauucgccgcuggcaggcggucagucaguggggaccugauucucgagaucggaaaacuuccacagcaccugacauuacgagcacagaaugccuuggauaaccugguuaugcuccacaauucugaacagggcgguaaggcuuacagacaugccauggaggaacugcccgacacuaucgagacccuuaugcugcucgcauugauugcggugcugacagggggcguaaccuuauuuuuccuauccggaaagggccuggggaaaacuagcauaggacuccuuugugugacagccucaagugcucuguuguggauggccagcgucgagccucacuggaucgcagcuuccauuauccuggaauuuuuccucauggugcugcuuauucccgagccagaucgccaaaggacgccucaggacaaccagcucgccuauguugugaucggucuguuguuuaugauacugaccgucgcagccaacgaaaugggcuuacuagagacuacaaagaaagaucuggggaucggacauguagcugcggagaaucaccaacacgccaccaugcucgacguggaucuucggcccgcaucugcuuggacccuguacgccguugccacaacugugauuacgccaaugaugcgucauaccaucgaaaacacaacugcaaauauuagcuugaccgcuaucgccaaccaggcggcuauacugaugggccucgacaaggguuggccuauuuccaaaauggauaucggggucccgcugcuugccuuaggcugcuacucacaggugaauccccugacacucaccgcagccgucuugaugcugguggcucacuaugcaauuaucggaccaggccuacaggccaaggcgacuagagaggcucaaaagaggacggccgcagggauaaugaaaaacccuacaguugacggaaucguggccauugaucuggaccccguaguguacgacgcuaaguucgaaaaacagcucggccagaucaugcuucugauuuuguguaccucucagauccugcucaugcgcacuaccugggcccugugcgagaguauaacauuagcaacugguccacuuaccacacugugggaagggucgccuggaaaguuuuggaauacgaccauugcugucagcauggccaacaucuuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacaccuacaagcgcagugggaucauggagguugaucggucugaagccaaagagggacugaagagaggcgaaacuacaaaacaugcagugagccgugguaccgcuaaguugaggugguucgucgagcggaaucuggugaagcccgagggcaaaguaauugaccucggguguggacgcggcggguggucauauuacugcgccggauuaaagaaagugacggaaguuaagggcuauaccaaaggugggccgggacacgaggaaccaaucccuauggccacauacggcuggaaccuggugaagcuucauuccggcaaagaugucuuuuucaugcccccagagaagugugacacucugcuaugcgauauaggggaaaguagccccaauccuaccauugaggagggacgaacacucagagugcugaagauggucgaaccgugguugagggguaaccaguuuuguaucaaaauucugaaucccuacaugccaucugugguugaggcgcucgaacaaaugcagcggaagcacggcgggaugcuuguacgcaacccucuguccagaaauucaacucacgagauguauugggugagcugcggaaccggcaacaucgucucggcugugaacaugacaucuaggauguuacugaaucgauucaccauggcacaucggaaacccacuuacgagcgugacguugauuugggugccgggacgagacacguggcugucgaaccugagguggccaaccucgacauaaucggacagcgcauugaaaauaucaagaacgagcauaaaaguacauggcacuaugaugaagacaauccauacaagaccugggcauaucacggcuccuacgagguaaagcccagcggcucagccuccucuauggugaacgggguugucaggcugcuaacuaaaccuugggaugugauuccaauggugacccaaaucgcuaugacagacacgacccccuuuggacagcagcgggucuucaaggagaaaguugacacuagaacaccgcgcgcgaagagggguaccacucagauuauggaagugacagccaaauggcuuuggggcuuucugagccgaaauaagaagccucggaucuguaccagagaggaauucacaaggaaaguacgcaguaacgcagcuauaggggccguguuugucgaugagaaucaauggaacuccgcaaaggaagccguggaggacgagcguuucugggaucucguucaucgggaaagagagcugcacaaacagggaaagugcgcuacuugcguguauaauaugaugggcaaaagggaaaagaaguugggugaguuugggaaagccaagggaagccgcgcgauuugguacauguggcugggcgcacgauuccucgaauucgaggcccuuggcuuuaugaacgaggaccauugguucucucgggaaaauucacugaguggggucgagggagaagguuuacacaaacugggcuacaucuugagagauaucuccaagauuccagggggaaacauguaugcugacgauaccgccggcugggacacgaggauaaccgaggaugaccuccagaaugaggcaaaaaucacagaaauuauggagcccgaacaugcucugcuagccacuagcaucuuuaagcuuaccuaccagaacaaagugguacgcguucaaagaccugcuaagaacgguacagugauggaugucauuucucggagggaccagcgugggucgggacaggugggcacuuauggccugaauaccuucacgaacauggaggugcagcucauccgacaaauggaaucagaggggauauuucugccaagcgaguuggaaacacccaauuuagccgagcgcguccuggauuggcucgaaaagcacggagcagagagacuuaaacggauggcgaucuccggugacgacuguguugugaagccgauugaugacagguucgccaccgcucugacugcccuaaacgauaugggcaaaguacgcaaggacaucccucagugggaacccaguaaaggguggaaugauuggcagcaggugccauuuugcucucaccauuuccaccaacugauuaugaaggacggaagagagaucgucgugccuugucggaaccaggaugagcucguuggcagggcacgagugagccagggugcugggugguccuugcgugaaacagccugccugggaaagucauacgcacaaauguggcagcuuauguauuuucauagacgcgaccugcggcucgccgcgaaugcuauauguagugccguccccguggauuggguaccaaccucuaggacuaccuggagcauucacgcacaccaucaguggaugacaacggaggacauguuauccguuuggaacagaguguggaucgaagagaaucccuggauggaagauaaaacccacgucucaagcugggaggaggugccuuaccugggcaagcgcgaagaccaguggugcggcucuuugaucgggcugacugcccgggcuacaugggccaccaacauucaaguugcaauaaaucaggugaggcgacucaucggaaacgagaauuaucuugacuacaugacuuccaugaaaagauucaagaacgaaagugauccagagggugcucugugguga

SEQ ID NO: 13389 - RNA, 9879 nt, Artificial Sequence
  derived and/or modified CDS sequence (opt3) from DENV-1__KJ189346__SS-prME
agcgugaccaugcugcucaugcuucugccaacugcauuggcuuuccacuuaacuacgagaggaggggaaccucauaugaucgucuccaagcaggaaaggggaaaaucucugcuguuuaagaccucagccgguguuaacaugugcacacucauugccauggaccugggcgaacuuugugaagauacuaugaccuacaaaugcccacaaauaaccgaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagaugaguggaacgaccacaauauuugccggccaucuaaaaugccggcucaagauggacaaacugacucuuaaggggaccucuuaugucauguguacaggauccuucaaauuggagaaggaaguggcugagacucagcacgguaccguccuggugcaaguuaaguacgagggcacggaugcgccuugcaaaaucccauucagcacacaggacgaaaagggggugacccagaacggacgucucauuacugcaaaucccaucguaacagauaaagagaagccugucaacauagaaaccgagccacccuuuggcgagucguauauugugguuggugccggggaaaaagcucugaaacuuucuugguucaagaaaggcuccucaaucggaaagauguuugaggccacugcacgcggcgccagaaggauggcuauccugggggacaccgccugggauuucggaaguauugguggcguguuuacaagcgucgggaaauuggugcaucagguauucggaacggcauacggcgugcucuuuuccgguguuucuuggaccaugaagaucgggauuggcauacuguuaacuuggcugggacuaaauagccggucaacaagucucuccaugaccuguaucgcggucggcauggugacacuguaccuuggggugaugguccaagcugacagcggaugcguuauuaacuggaaaggccgagaauugaagugugguucugggaucuucgugacuaacgaggugcacaccuggacggaacaguauaaguuucaggccgauucaccgaaacgccugagugcagccaucggaaaggcuugggaggagggcguaugcgguauuagaagcgccacaaggcucgaaaauauaauguggaaacagaucuccaacgagcugaaucauauuuuacuggaaaacgacaugaaguucaccgucgugguuggcgacgcaaaugggauccuugcucaaggcaagaagaugauucggccucagcccauggagcacaaauacucuuggaagucguggggcaaggccaaaaucauaggggcggauauccagaacacuaccuuuauuaucgacggaccagauacaccugaaugucccgacaaucagcgcgccuggaacauuugggagguggaggauuauggcuucgguaucuuuacuaccaauauaugguugaagcucagagacagcuacacacaaaugugcgaucacaggcugauguccgcugcaauuaaagacucaaaggccguccaugcugauaugggguauuggaucgaaagugagaaaaacgaaacguggaagcuagcccgugcaucuuucauugaggugaagaccuguacuuggccaaaaagccacacacugugguccaauggaguuauggaaucagagaugaucauacccaagaucuacggcgguccuauuagccagcauaacuaucggccaggcuacuucacccagacugcggggccguggcaccucggaaaacuggagcuugacuuugauuugugcgaaggcacaaccgugguagucgacgagcacugcgggaaucgaggacccucucugagaacgacuaccgugacaggcaagaucauucaugaaugguguugcagguccuguaccuuaccuccacuccgcuuccggggugaggaugggugcugguacggaauggagaucagacccgugaaagaaaaggaggaaaaccuggucaggaguaugguuagcgccggcucuggugagguggacuccuuuucacuuggcauacugugugcuaguauuaugaucgaagagguaaugcgcagccgauggucgcggaagauguugaugacugggacacucgccguguuccugcuacuggucaugggacaacucaccuggaaugaccugauccgucuuugcauuauggugggcgcaaacgcuuccgauagaauggggaugggaacaacuuauuuggcccugauggcaaccuuuaaaaugaggccuauguucgccguuggcuuacucuuucgccggcugacgucuagagaggugcuucugcuaacaaucggucucagccuggucgcuucaguggaauugccaaacagucuggaggaauuaggggacggacucgcgaugggcauuaugaugcugaaacuucugaccgaguuccagccccaccaguuguggacuacccuccugucccuaacauuuauaaaaacuacccugucucuugauuacgccuggaagacgacagcaauggcucucagcaucguuucccuguucccguugugucugucaaccacuagccagaaaacaaccugguuaccugugcuccugggcaguuuugggugcaagccacuuacuauguuccugauuacagaaaauaagaucuggggaaggaaaucuuggcccuugaacgaggguauuauggccaucggcauagucuccauccuccugagcucgcuacugaagaaugacguaccucuugccgggccccucauugcuggaggcaugcugaucgcauguuaugugauuucagguucuagugccgauuuguccuuagagaaagcggcugaaguuagcugggagcaagaagccgagcauucugggaccagccacaacauccugguggaaguccaggacgauggaacgaugaagauaaaagacgaggagcgagaugacacucucaccauucugcuuaaggcaacacuguuggccguguccggcguauacccaaugucaaucccugcuacccuauuucugugguauuucuggcagaaaaagaagcagcgcaguggcgugcucugggauacacccagcccaccggaagucgagcgggcaguucuggacgaugggaucuacaggauucuucaacgaggauuacugggucguucucaggugggcgugggggucuuccaggacggaguguuucauacuauguggcacguuacccgcggcgccguacucauguaucaggguaaacgguuggaaccuuccugggcgucagugaagaaagaccugauaaguuacgggggaggcuggagauuccaaggcagcuggaauacgggggaggagguccaggugaucgcuguugaacccggaaagaaccccaagaaugugcagacaacucccgguaccuuuaagacaccugagggcgaagucggggccauugcacucgauuucaagccaggaaccuccggcucucccaucgugaacagggaggguaaaauuguagggcuguacggaaauggcgucgugacuaccucgggcacauauguuagcgccaucgcucaagccaaggcaucacaggaagggccucuuccggagauagaggacgaaguguuuaaaaagcgaaaccugacgaucauggauuugcacccaggauccgguaaaacucggcgcuaccuacccgcuauugucagagaggccaucaagaggaagcugcggacccucauuuuagcgccuacacgagugguugccagugaaauggcagaggcucugaaaggcaugccaaucagauaucagaccacugccgugaagucugaacauacagggcgcgagauagucgaccuuaugugccacgcuaccuucacgaugaggcugcucagccccgugcguguaccuaauuacaacaugauuaucauggaugaggcacauuuuacugacccggccuccaucgccgcucggggauauauuucaacaagagugggcaugggugaagcggcagccaucuucaugaccgcuacacccccagggucuguugaggccuuuccucagagcaaugcagucauacaagaugaagagagggacauucccgaacgcaguuggaacuccggauacgauuggaucacugacuucccaggcaaaacagugugguuugugccuagcauuaagucuggcaaugauaucgccaacuguuugagaaagaacgggaaaagagucauacagcugucacggaagaccuucgacacagaguaucagaaaacuaagaauaacgacugggauuacguagugacgaccgacauuuccgagaugggagcuaauuucagggcggaucgcguuaucgacccccguagaugccucaaaccagugauccugaaggaugguccggaacgggucauucuugccggcccuaugcccgugacaguugcaagugcugcccagaggcgcgggcgaaucggaagaaaccaaaauaaagagggcgaccaguacguguauaugggucagccacuaaacaaugaugaagaccacgcacauuggacugaggccaagaugcuguuggauaacauuaauacccccgaggggauaaucccugcuuuauuugaaccagagcgggaaaagagcgccgcgauugacggcgaguacaggcugcgcggagaagcaagaaaaacauucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggaccaaagaaggugagagaaagaaacucaggccucggugguuggacgcucgcacuuauagcgauccgcuggcccuaagagaguuuaaggaguucgcugcaggcaggcggucagucaguggggaccugauccucgagauuggaaaacuuccacagcaccugacgucucgagcccagaaugcuuuagauaacuuggugaugcugcacaauuccgaacagggcgguaaggccuacagacaugcaauggaggaacuccccgacaccauagagacacugaugcuucuggcgcucaucgccguguugacugggggcgucacccuguuuuucuuaagcggaaagggccuagggaaaacaucaauuggacugcucuguguuaccgcuaguagcgcccuucuguggauggcauccguggagccucacuggaucgcugccucuauuaucuuggaauuuuuccugaugguacuccugauacccgagccagaucgccaaaggacuccucaggacaaccagcuugcauauguggucaucggucuccuguuuaugauuuugacaguggccgcuaacgaaaugggccuguuagagacgaccaagaaagaucuagggaucggacauguugcggccgagaaucaccaacacgcaacuaugcuggacguggaucuccggcccgcuagcgccuggacacuuuacgccgucgcaaccaccguaauuacaccaaugaugcgucauacuaucgaaaacacgaccgcuaauauaucccugacagccauugcgaaccaggcugccaucuugaugggccuggacaaggguuggccuauuucaaaaauggauaucggggugccgcuccuggcacuuggcugcuacucucagguuaaucccuuaacucugaccgccgcugugcucauguuggucgcacacuaugccauaaucggaccaggccugcaggcgaaggcuacaagagaggcccaaaagaggaccgcagccgggauuaugaaaaacccuacuguggacggaaucgucgcuauugaucuagaccccgugguuuacgacgccaaguucgaaaaacagcugggccagaucaugcuccuuauacuguguacgagucagauuuugcugaugcgcacaaccugggcacucugcgagucgaucacucuggcuaccgguccauuaacaacucuuugggaagggagcccuggaaaguuuuggaauaccacaaucgccguguccauggcgaacauuuuccggggcucuuaucuggccggugcaggccucgcuuucucacuaaugaaaagccuagggggaggccgaagagggacgggagcccaaggcgagaccuugggugagaaguggaagaggcagcugaaucagcucuccaaaagugaauuuaacacuuacaagcgcucugggaucauggagguagaucggagcgaagcaaaagagggacuuaagagaggcgaaacaaccaaacaugcugugucacgugguacugccaagcugaggugguucgucgagcggaauuugguuaagcccgagggcaaagugauagaccugggguguggacgcggcgggugguccuauuacugcgccggacucaagaaagucacagaagugaagggcuauaccaaaggugggccgggacacgaggaaccaauuccuauggcgacguacggcuggaacuuagcuaagcugcauaguggcaaagauguauuuuucaugcccccagagaagugugacacccuucugugcgauaucggggaaagcucucccaauccuacaauugaggagggacgaacucuaagagugcucaagaugguugaaccguggcugagggguaaccaguuuuguaucaaaauauugaaucccuacaugccauccguggucgagacccuggaacaaaugcagcggaagcacggcgggaugcucgugcgcaacccucuuucaagaaauagcacacacgagauguauugggucucgugcggaacuggcaacaucgugucugcaguuaacaugaccaguaggaugcuguuaaaucgauucacaaccgcccaucggaaacccacuuacgagcgugacguagaucugggugcugggacgagacacguggccgucgaaccugagguggcaaacuuggacauuaucggacagcgcauugaaaauaucaagaacgagcauaaauccacauggcacuaugaugaagacaauccauacaagaccugggccuaucacggcagcuacgagguuaagcccucaggcuccgcuucuagcauggugaacggggucgugaggcuccugacuaaaccuugggauguaauuccaauggugacccaaaucgcgaugacagacacgacccccuuuggacagcagcggguuuucaaggagaaagucgacacuagaacaccgcgcgccaagagggguaccacucagauaauggaagugacagcaaaauggcuauggggcuuucuuagucgaaauaagaagccucggauuuguaccagagaggaguucacaaggaaagugcgcuccaacgcugccaucggggcagucuuuguugaugagaaucaauggaacagcgccaaggaagcuguggaggacgagcguuucugggaucugguacaucgggaaagagagcuccacaaacagggaaagugcgccacuugcguguauaauaugaugggcaaaagggaaaagaagcugggugaguuugggaaagcgaagggaucucgcgcaaucugguacaugugguugggcgcccgauuccuggaguucgaggcucucggcuuuaugaacgaggaccauugguucucacgggaaaauagucuuuccggggucgagggagaaggucugcacaaauuaggcuacauucugagagauauaagcaagaucccagggggaaacauguaugccgacgauaccgcaggcugggacacgaggauuaccgaggaugacuugcagaaugaggcuaaaaucacagaaauuauggagcccgaacaugcccuccuggcuacuucuaucuuuaagcuaaccuaccagaacaaagugguucgcgugcaaagaccugccaagaacgguacagucauggaugugauaucgcggagggaccagcgugggucaggacagguaggcacuuauggccuuaauaccuucacgaacauggagguucagcugauccgacaaauggaaagcgaggggauuuuucucccauccgagcuggaaacacccaauuuggcagagcgcguguuagauuggcuggaaaagcacggagcggagagacucaaacggauggccaucaguggugacgacugugucgugaagccgauugaugacagguucgcuaccgcccuuacugcacugaacgauaugggcaaagugcgcaaggacauccuacagugggaaccuucuaaaggguggaaugauuggcagcagguccccuuuugcagccaccauuuccaccaacugauaaugaaggacggaagagagauuguugugccaugucggaaccaggaugagcucguaggcagggcucgagugucccagggugccggguggucauugcgugaaacagcaugccugggaaagaguuacgcccaaauguggcagcuuauguauuuucauagacgcgaccugcggcucgcggcuaaugccaucuguucugcagucccuguggauuggguucccaccagcaggacuaccugguccauccacgcccaccaucaguggaugacaacggaggacauguuaucaguguggaacagagucuggauugaagagaauccauggauggaagauaaaacccacgugagcucuugggaggagguacccuaccugggcaagcgcgaagaccaguggugcggcuccuugauagggcugacugcucgggccacaugggcaaccaacauccaaguugcuauuaaucaggugaggcgacucaucggaaacgagaauuaucuugacuacaugacaaguaugaaaagauucaagaacgaaagcgauccugagggugcccugugguga

SEQ ID NO: 13390 - RNA, 9879 nt, Artificial Sequence
  derived and/or modified CDS sequence (opt3) from DENV-1__KJ189347__SS-prME
agcgugaccaugcugcucaugcuucugcccacugcauuggcuuuccacuuaacuacgcgaggaggggaaccucauaugaucgucuccaagcaggaaaggggaaaaucucugcuguuuaagaccucagccgguguuaacaugugcacucucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauuuucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggaccuuucaaauuggagaaggaaguggcugagacccagcacgguacgguccuggugcaaguuaaguacgagggcacagaugcgccaugcaaaauccccuuccucacccaggacgaaaagggggugacucagaacggacgucugauuacagcaaauccuaucguaaccgauaaagagaagccagucaacauagaaacugagcccccguuuggcgaguccuauauugugguuggugccggggaaaaagcucuuaagcugagcugguucaagaaaggcucgucuaucggaaagauguuugaggccaccgcacgcggcgccagaaggauggcuaucuugggggacacagccugggauuucggauccauugguggcguguuuacgucagucgggaaacucgugcaucagguauucggaaccgcauacggcgugcuguuuagugguguuagcuggacuaugaagaucgggauuggcauauuacugacauggcuaggacucaauucccggucuaccagccugucaaugacauguaucgcggucggcauggugacucuuuacuugggggugaugguccaagcugacaguggaugcguuauuaacuggaaaggccgagaacugaagugugguuccgggaucuucgugaccaacgaggugcacacguggacagaacaguauaaguuucaggccgauagcccuaaacgccucucugcagccaucggaaaggcuugggaggagggcguaugcgguauuagaucagccaccaggcuggaaaauauaauguggaaacagaucaguaacgaguuaaaucauauucugcuugaaaacgacaugaaguucacugucgugguuggcgacgcaaaugggaucuuggcucaaggcaaaaagaugauucggccccagccaauggagcacaaauacagcuggaaguccuggggcaaggccaaaaucauaggggcggauauccagaacaccacauuuauuaucgacggaccugauacucccgaauguccagacaaucagcgcgccuggaacauuugggagguggaggauuauggcuucgguaucuuuaccacaaauauauggcucaagcugagagacucuuacacgcaaaugugcgaucacaggcuaaugucggcugcaauuaaagacagcaaggccguccaugcugauaugggguauuggaucgaauccgagaaaaacgaaaccuggaagcuggcccgugcaucauucauugaggugaagacuuguacauggcccaaaagucacacccucuggucuaauggaguucuggaaagcgagaugaucauaccuaagaucuacggcgguccaauuucccagcauaacuaucggccgggcuacuucacucagacagcggggcccuggcaccuuggaaaauuggagcuggacuuugauuuaugcgaaggcaccacggugguagucgacgagcacugcgggaaucgaggaccuucacucagaacuaccacagugaccggcaagaucauucaugaaugguguugcaggagcuguacucugccaccccuucgcuuccggggugaggaugggugcugguacggaauggagaucagaccugugaaagaaaaggaggaaaaccuggucaggucuaugguuuccgccggcaguggugagguggacagcuuuucuuugggcauacucuguguauccauuaugaucgaagaggugaugcgcucacgauggagucggaagaugcugaugacagggacccuagcugucuuccugcuccuggugaugggacaacuuacauggaaugacuugauccgucugugcauuaugguuggcgccaacgcaagcgauagaauggggaugggaacuaccuauuuagcucucauggccacguuuaaaaugaggccaauguucgcagugggccugcuuuuucgccggcugacaucgagagagguccuacuccugaccaucgguuugucccugauggccucuguggaauuacccaacagccucgaggaacugggggacggacuugcuaugggcauuaugaugcugaaguugcucacugaguuccagccgcaccagcuguggaccacacuacugucacuuacuuuuauaaaaaccacgcucagucuggauuacgcguggaagacaaccgccauggcauuguccaucguuucucuguucccuuuaugucucagcacuacaucccagaaaaccacuuggcugccagugcuucugggcucauuugggugcaagcccuugacaauguuccucauuaccgaaaauaagaucuggggaaggaaaagcuggccucugaacgaggguauuauggcuaucggcauagucaguauccuacugucuucccuucucaagaaugacguaccccuggccgggccauugauugccggaggcauguuaaucgcuuguuaugugauuagcgguucgucagcagaucugucucucgagaaagccgcggaaguuaguugggagcaagaagcugagcauuccgggacgagccacaacauccugguggaaguccaggacgauggaacuaugaagauaaaagacgaggagcgagaugacacccuuacaauucuguugaaggccacccuacuggcagugucuggcguauacccuaugagcauccccgccacacucuuugugugguauuucuggcagaaaaagaagcagcgcuccggcguccugugggauacuccaucaccgccugaaguugagcgggcugugcuugacgaugggaucuacagaauuuuacaaaggggacugcucggucguagucaggugggcgucgggguguuccaggacggaguuuuucauaccauguggcacguaacgcgcggcgcaguguugauguaucaggguaaacggcuggaacccagcugggccucugucaagaaagaccucauauccuacgggggaggcuggagauuccaaggcucauggaauacaggggaggaggugcagguuaucgcgguggaaccaggaaagaaccccaaaaauguccagacuaccccugguacauuuaagaccccagagggcgaagugggggcuauugcccuggauuucaagcccggaacaaguggcagcccuaucguaaacagggaggguaaaauugucgggcuuuacggaaauggcgugguuaccacauccggcacguaugugucugcaaucgcccaagcuaaggccucgcaggaagggccgcugccagagauagaggacgaagucuuuaaaaagcgaaacuugacuaucauggaucuacaccccggaagcgguaaaacccggcgcuaccugccugcaauugugagagaggcuaucaagaggaagcuccggacauuaauucuggccccaacccgaguuguggcgucagaaauggccgaggcacuuaaaggcaugcccaucagauaucagacuacagcugucaaguccgaacauaccgggcgcgagauaguggaccugaugugccacgccacguucacuaugaggcucuugaguccuguacgugugccgaauuacaacaugauuaucauggaugaggcucauuuuacagaccccgcaucuaucgccgcccggggauauauuagcaccagaguuggcaugggugaagcugcggcaaucuucaugaccgccacuccaccuggguccgucgaggcuuuuccccagucaaaugccgugauacaagaugaagagagggacauuccagaacgcucuuggaacagcggauacgauuggaucacagacuucccuggcaaaaccgugugguuuguccccaguauuaaguccggcaaugauaucgcaaacugucugcggaaaaacgggaagagaguaauacagcucagcagaaagacauucgacacugaguaucagaaaacgaagaauaacgacugggauuacgugguuaccacagacauuucugagaugggagccaauuucagggcugaucgcgugaucgacccacguagaugccugaaaccggucauccuuaaggaugguccugaacgggugauucuagcgggccccaugccaguuacuguggccucagcagcucagaggcgcgggcgaaucggaagaaaccaaaauaaagagggcgaccaguacgucuauaugggucagccccugaacaaugaugaagaccacgcccauuggaccgaggcaaagauguuguuagauaacauuaauacaccugaggggauaaucccagcccuguuugaacccgagcgggaaaaguccgcugccauugacggcgaguacaggcuccgcggagaagcgagaaaaaccuucguggagcugaugaggcggggcgaucuuccuguauggcugaguuauaagguggcaagcgagggguuucaguacucggaccgucgcuggugcuucgauggagaacgaaacaaucaaguucucgaggaaaacauggacgucgagaucuggacuaaagaaggugagagaaagaaauugaggccgcgguggcuggacgcccgcacguauucugauccacuagcucugagagaguuuaaggaguucgccgcuggcaggcgguccgugagcggggaccucauccuugagauuggaaaacugccccagcacuuaaccuugcgagcacagaaugcccuggauaaccucgugaugcugcacaauucagaacagggcgguaaggcuuacagacaugccauggaggaacuuccugacacaauagagacucugaugcucuuggcacugaucgcggucuuaaccgggggcguuacacuauuuuuccugaguggaaagggccucgggaaaaccucuauuggacuucugugugugacugccuccagcgcuuugcuguggauggccucaguagagccccacuggaucgcagcuaguauuauccucgaauuuuuccugauggugcuucucauaccagagccugaucgccaaaggacaccccaggacaaccagcuggccuaugucgugaucgguuugcuguuuaugauuuuaacgguugcagccaacgaaaugggccuacuggagaccacuaagaaagaucucgggaucggacauguggcugcggagaaucaccaacacgccacaaugcuugacgucgaucugcggccagcaagcgcuuggaccuuguacgccguagccaccacagugauuacuccuaugaugcgucauacgaucgaaaacaccacagcaaauauaucccugacugcuauugccaaccaggcggcuauccucaugggccuggacaaggguuggccgauuucuaaaauggauaucgggguuccccuuuuagcccugggcugcuacagccaggugaauccacucaccuugacagcagccguccugaugcuaguggcucacuaugcaauaaucggaccuggccugcaggccaaggcgaccagagaggcucaaaagaggacugccgcagggauuaugaaaaaccccacggucgacggaaucguggccauugaucucgacccaguuguguacgacgcuaaguucgaaaaacagcuuggccagaucaugcuguugauacuguguacaucccagauucuccugaugcgcaccacuugggccuuaugcgagucaaucacccuugcaacagguccucugacuacccucugggaagggucucccggaaaguuuuggaauacaacgaucgcuguaaguauggccaacauuuuccggggcucguaucuagcgggugccggccuggcauucagcuugaugaaaucccuagggggaggccgaagagggaccggagcucaaggcgagacucucggugagaaguggaagaggcagcuuaaucagcugucuaaaucagaauuuaacacauacaagcgcagcgggaucauggagguggaucgguccgaagccaaagagggauugaagagaggcgaaaccacuaaacaugcagucagucgugguacagcuaagcugaggugguucguugagcggaaucucgugaagccggagggcaaagucauagacuuaggguguggacgcggcggguggucuuauuacugcgccggacugaagaaagugaccgaaguaaagggcuauacgaaaggugggccaggacacgaggaaccuauucccauggccaccuacggcuggaaccuugugaagcugcauagcggcaaagauguauuuuucaugccacccgagaagugugacacacuacucugcgauaucggggaaucauccccuaauccgacuauugaggagggacgaacccugagaguguugaagauggucgaacccuggcugagggguaaccaguuuuguaucaaaauacucaauccauacaugccuaguguggucgagacacuugaacaaaugcagcggaagcacggcgggaugcuggugcgcaaccccuuaagcagaaauucuacucacgagauguauuggguuuccugcggaaccggcaacaucguaucagcggugaacaugacaagcaggaugcuguugaaucgauucaccauggcucaucggaaaccuacuuacgagcgugacgucgaucucggugcagggacgagacacguggccguugaaccagagguggcuaaccuggacauuaucggacagcgcauugaaaauaucaagaacgagcauaaaucgacauggcacuaugaugaagacaaucccuacaagaccugggccuaucacggcucuuacgaggucaggccuaguggcuccgcaagcucaauggugaacgggguagugcggcuacuuacuaagccaugggauguuauucccauggucacccaaaucgccaugacagacacgaccccguuuggacagcagagaguguucaaagagaagguggacacucgcacaccuagggcuaaacgagguaccacucagauaauggaagucacagcgaaguggcuguggggcuuucucucccggaauaaaaagccaagaauuuguaccagggaggaguucacacgcaagguucguucuaacgccgcaaucggggcuguguuuguagaugagaaucaauggaacagcgccaaagaagcaguggaggacgagcgguucugggaucugguccauagagaaagggaguugcacaagcagggacgcugcgccacuugcguguauaauaugaugggcaaacgagaaaagaaacugggugaguuugggaaggcuaagggaagucgggccaucugguacauguggcucggcgcgagauuccuugaguucgaggcacugggcuuuaugaacgaggaccauugguucuccagggaaaauagcuuaucugggguugagggagaaggucugcacaaauugggcuacauucuccgcgauauaucaaagauccccgggggaaacauguaugccgacgauaccgcuggcugggacacgagaauuaccgaggaugaccugcagaaugaggccaaaaucacagaaauuauggagccugaacaugcacuacuugcuacaaguaucuuuaagcugaccuaccagaacaaagugguccgggugcaaaggccagccaagaacgguacaguaauggauguuauaucccgucgagaccagcgcgggagcggacaggugggcacuuauggccucaauaccuucacgaacauggagguccagcugaucagacaaauggaaucugaggggauauuuuugcccucggaguuagaaacaccgaaucuggcugagcgggugcucgauuggcuugaaaaacacggagccgagaggcugaagcgcauggcaaucucaggugacgacuguguggucaagccuauugaugacagauucgcgaccgcccuaacugcucugaacgauaugggcaaaguucggaaggacaucccccagugggaaccaagcaaaggguggaaugauuggcaacaggugccuuuuugcucccaccauuuccaccaacucauaaugaaggacggaagggagauuguagugcccugucgaaaccaggaugaguuggucggccgugccagagugagucagggugcaggguggucucugcgcgaaacagcuugccuuggaaaaagcuacgcccaaauguggcagcugauguauuuucaucggagggaccucagauuagcagccaaugcgaucuguuccgcuguuccaguggauuggguccccaccucacgcacuaccuggaguauccacgcccaccaucaguggaugacaacggaggacaugcugucuguguggaaccggguauggauugaagagaauccuuggauggaagauaagacccacguuagcuccugggaggaggugccauacuugggcaagagggaagaccaguggugcggcucacugauagggcucacugcacgagccacaugggcuaccaacauccaagucgccauuaaucaggugagacggcuuaucggaaacgagaauuaucuggacuacaugacuagcaugaaaagguucaagaacgaaucugauccggagggugcacuaugguga

SEQ ID NO: 13391 - RNA, 9879 nt, Artificial Sequence
  derived and/or modified CDS sequence (opt3) from DENV-1__KJ189348__SS-prME
agcgugaccaugcugcucaugcuucugcccacagccuuggcuuuccacuuaacuacgagaggcggggagccucauaugaucgucuccaagcacgaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaucgccgagacaagcguagcguggcccuggcaccccacgucggcuugggucucgagacuagaaccgaaacauggauguccucugagggggccuggaaacaaauccagaggguggaaacuugggcucugcggcauccuggauucaccguuauugcacuguuucucgcccacgcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucagggagaggccaccuuggucgaagagcaagaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucauaccggagaucagcaccagguggguaaugagacuacggaacauggcacaaucgccaccauuacuccccaagcgccuaccucagagauccagcuuacagacuacggggcccugaccuuggacuguaguccaaggacuggacuagauuucaacgaaaugguccugcucacaaugaaggagaaaagcuggcuggugcacaagcagugguuucuugaccugccguugcccuggacgucuggcgcauccaccucacaggagacuuggaaucggcaagaucuccugguaacauucaaaaccgcucacgccaagaagcaggaaguuguggucuuagguagccaggagggggcuaugcauacagcccugacuggcgcaaccgaaauccaaacgaguggaaccacaacuauuuuugccggccaccuaaaaugccgucucaagauggacaaacugacccuuaaggggacaucuuaugugauguguacuggauccuucaaauuggagaaggaagucgcugagacccagcaugguacggugcugguucaggugaaguacgagggcacagaugcgccuugcaaaauaccauucagcacccaggacgaaaaggggguaacucaaaacggacgccucaucacagcaaaucccauugucaccgauaaagagaagccugugaacaucgaaacugagccacccuuuggcgagucguauauaguugugggugccggggaaaaagcucugaagcuuucuugguucaagaaaggcuccucaauuggaaagauguuugaggccaccgcaagaggcgccaggcggauggcuauccugggggacacagccugggauuucggaaguaucgguggcgucuuuacgagcguggggaaauugguacaccagguguucggaaccgcauacggcguucucuuuuccggugucucuuggacuaugaagauugggaucggcauucuguuaacauggcugggacuaaauagccgaucaaccaguuucuccaugacauguauagcggugggcauggugacucucuaccugggggucaugguucaggcugacagcggaugcgugaucaacuggaaaggccgcgaacuuaagugugguucugggauuuuugugaccaacgagguacauacguggacagaacaguauaaguuccaagccgauucaccgaaaagauugagugcagccaucggaaaggcuugggaggagggcgucugcgguaucaggagcgccacccggcuggaaaauauuauguggaaacagauauccaacgagcucaaucacauccuguuagaaaacgacaugaaguuuacugugguugugggcgacgcaaaugggauucuggcucagggaaaaaagaugauccgcccucagcccauggagcacaaauacucuuggaagucguggggcaaggccaaaauuaucggggcggauauacaaaacaccacauucaucauugacggaccagauacuccugaaugucccgacgaucagagagccuggaauaucugggaggucgaggacuauggcuuugguauuuucaccacaaacaucuggcuuaaguugagggauagcuacacgcagaugugcgaccaucgucucauguccgcugcaauaaaagauucaaaggccgugcacgcugacaugggguauuggauugaaagugagaaaaaugaaaccuggaagcuggcccgggcaucuuucaucgagguuaagacuuguacauggccaaaaagccauacccuaugguccaacggagugcuggaaucagagaugauuauccccaagauauacggcgguccuaucagccagcacaauuaucgaccaggcuacuuuacucaaacagcggggccguggcaccucggaaaacuggagcuugauuucgacuugugcgaaggcaccacgguagucguggaugagcauugcgggaacagaggacccucucugaggacuaccacagugaccggcaagauuauccacgaaugguguugccgcuccuguacuuuaccuccacuccgguuuagaggugaggacgggugcugguacggaauggagauuaggcccgucaaagaaaaggaggaaaaucugguucgcaguauggugagcgccggcucuggugagguagacuccuucucacuuggcauccugugugugaguauaaugauugaagaggucaugcgaagccgguggucgcguaagauguugaugacagggacccucgcuguguuucugcuacugaucaugggacagcucacauggaacgaucugaucagacuuugcauuaugguuggcgccaaugcauccgacaggauggggaugggaacuaccuauuuggcucugauggccacguucaaaaugcgcccuauguuugcagugggcaucuuauuccggagacucacaucuagggagguccugcuucugaccauuggucuaagccucguggccucaguugaacugccaaacaguuuggaggaacugggggauggauuagcuaugggcauaaugaugcucaagcugcuuacugaguuucagccccaucaacuguggaccacauugcucucccugacuuucaucaaaaccacgcuaucucuggacuacgcguggaagacaaccgccauggcacuuagcauugugucccucuuuccgcuguguuugucaacuacaagccagaaaaccacuuggcugccugucuuacucggcaguuucgggugcaagccacugacaauguuucuuaucaccgaaaacaagauuuggggacgaaaaucuuggcccaucaaugaggguauaauggcuaucggcauuguauccauccuguugagcucgcuccugaagaacgaugugccucuagccgggccccugauugccggaggcaugcuuaucgcuuguuauguuauaucagguucuagugcagaccucucccuggagaaagccgcggaagugagcugggagcaggaagcugagcacucugggacgagccauaauauuuuggucgaagugcaggaugacggaacuaugcgcaucaaggaugaggagaaagacgauaccuuaacaauccugcucaaggccacccugcuugcaguauccggcguguacccaaugucaauuccugccacacuguucgucugguauuucuggcaaaaaaagaagcagcggaguggcguuuugugggacacucccagcccaccggaaguggagagagcugugcuagaugacgggauauacaggauccugcagcguggacuccugggucgcucucaggucggcguggggguuuuucaagacggaguauuccacaccauguggcacgugacgcggggcgcaguccuuauguaucaggguaaaagauuagaaccuuccugggccucagugaagaaagaucugauuaguuacgggggaggcuggagguuucagggcagcuggaacacaggggaggagguucaggugaucgcggucgaacccggaaagaauccaaaaaacgugcaaacuacccccgguacauucaagaccccugagggcgaaguaggggcuauugcccucgacuuuaagccaggaacuuccggcucucccaucgucaaucgagaggguaaaauagugggguuguacggaaacggcguugugaccacaucgggcacguaugucagcgcaaucgcccaggcuaaggccucacaggaagggccucugccggagauugaggaugaaguguucaaaaagcggaaucucacuaucauggaccugcauccaggauccgguaaaacccgcagauaccuucccgcaauuguuagggaggcuaucaagcggaagcugcgaacauugauacuagccccuaccagaguggucgcgagugaaauggccgaggcacugaaaggcaugccaauucgcuaucaaacuacagcugugaagucugaacacaccgggagggagaucguagaucucaugugccaugccacguuuacuaugcguuuacugagccccgugcggguuccuaacuacaauaugaucauuauggacgaggcucacuucacagauccggcauccaucgccgccagaggauauauaucaaccagggucggcaugggugaagcugcggcaauuuuuaugaccgccacucccccagggucuguggaggcuuucccucagagcaacgccgugauccaggacgaagagcgcgauauucccgaacgaaguuggaauuccggauacgacuggaucacagauuuuccaggcaaaaccgucugguucguaccuagcauaaagucuggcaacgacauugcaaauugucuuagaaaaaacgggaagcgggugauccagcugucaaggaagacauucgacacugaguaucaaaaaacgaagaacaaugauugggacuacguugugaccacagauaucuccgagaugggagccaacuuucgcgcugaccgugucauugaucccagacggugccucaaaccagugaucuugaaggacgguccggaaaggguuauucuggcgggcccuaugcccgugacugucgccagugcagcucagcgccgagggagaauaggacggaaucagaacaaagagggcgaucaguacguguauaugggucaaccacucaauaacgacgaagaucaugcccacuggaccgaggcaaagaugcugcuugacaauaucaacacacccgaggggauuaucccugcccuauucgaaccagagagggaaaagagcgcugccaucgauggcgaguaccgccugagaggagaagcgaggaaaaccuuuguagaguugaugcggcguggcgacuuacccguguggcugucguauaagguugcaucugagggguuccaguacuccgaucgccgauggugcuuugacggagaaagaaauaaccagguccucgaggaaaauauggacguggagauuuggacuaaagaaggugagaggaagaaacugcggccucgcuggcuugaugccagaacguauagcgacccgcuggcucucagggaguucaaggaauuugccgcuggccggcgaucagugaguggggauuugauacuggagaucggaaaacuaccacagcaccugacccucagagcacaaaacgcccuugacaaucuggucauguuacauaacucugaacagggcgguaaggcuuaccgccacgccauggaggaauugcccgauacaauugagacucugaugcuccuggcacuuaucgcgguucugaccgggggcgugacacucuucuuuuuguccggaaagggccuggggaaaaccagcauuggauuacuauguguaacugccucaagugcucugcucuggauggccagcguggagccucauuggaucgcagcuuccauaauccuugaauucuuucugauggucuugcugauucccgagccagacaggcagcggacaccucaggauaaucaacucgccuaugugguuaucggucugcuuuucaugauucucacgguggcagccaacgaaaugggccuguuggagaccacuaagcgugaccuggggaucggacacgucgcugcggagaaccaccagcaugccacaauguuagauguagaccuaagacccgcaucugcuuggacccuguacgccguggccaccacaguuauaacuccaaugaugaggcacacgauugaaaauaccacagcaaacaucagccucacugcuauugccaaucaggcggcuauccuuaugggccuggauaaagguuggccuauauccaagauggacaucggggugccguugcuggcccucggcugcuacucacaagucaacccccugacccuuacagcagccguguuaaugcuggucgcucauuaugcaauuaucggaccaggccuccaggccaaagcgacccgcgaggcucagaagcggacugccgcagggauuaugaagaauccuacgguggauggaaucguugccauagacuuggaccccgugguauacgaugcuaaauuugaaaagcagcugggccaaauuaugcuacugauccucuguacaucucagauccuucugaugcgaaccacuugggccuugugcgagaguauuacccuggcaacagguccacucacuacccugugggaagggucgccuggaaaauucuggaacacaacgaucgcugugagcauggccaauauauucagaggcuccuauuuagcgggugccggccuugcauuuucucugaugaagucacucgggggaggcaggcgcgggaccggagcucagggcgagacucuaggugagaaauggaagcggcagcugaaccaauugagcaagcccgaauucaauacauacaaaagauccgggauuauggaggucgaccguagugaagccaaggagggacugaaaaggggcgaaaccacuaagcacgcaguuucucgggguacagcuaaacuccgcugguuuguggagcgaaaccuugucaagccggagggcaaggugaucgaucugggguguggaagaggcggguggagcuauuacugcgccggauugaaaaagguaaccgaagugaaaggcuauacgaagggugggccaggacaugaggaaccuauucccauggccaccuacggcuggaaucugguuaaacuccacucaggcaaggacguguucuuuaugccacccgagaaaugugauacauuacugugcgacaucggggaauccaguccuaacccgacuauagaggagggaaggacccuucggguccugaagaugguggaacccuggcuacgcgguaaucaguucuguaucaagauucucaacccauacaugccuagcgucguggagacacuggaacagaugcagagaaaacacggcgggauguugguuaggaauccccugucucgaaacuccacucaugagauguauuggguaucaugcggaaccggcaauaucgugagcgcggucaacaugacaucgcggaugcuccuuaaccguuuuaccauggcucacagaaagccuacuuacgagcgcgauguggaccugggugcagggacgaggcauguugccguggaaccagaggucgcuaauuuagauauuaucggacaacggauugaaaacaucaaaaaugagcacaagucuacauggcacuaugacgaagauaaccccuacaaaaccugggccuaucauggcaguuacgaggugaagccuuccggcagcgcaucauccaugguaaauggggugguuagacuguugacuaagccaugggacgucauacccauggugacccagauugccaugacagacacgaccccguucggacagcaacgcguguuuaaagagaaggucgauacuaggacaccucgagcuaaacgggguaccacucagaucauggaaguuacagcgaaguggcucuggggcuuccugucuagaaacaaaaagccaaggaucuguacccgcgaggaauuuacacguaaggugcggagcaaugccgcaauuggggcuguauucguggacgagaaccaguggaauagugccaaagaagcagucgaggaugagagauuuugggaccuagugcacagggaacgcgagcuucauaagcagggaaaaugcgccacuugcguuuauaacaugaugggcaagcgagaaaaaaagcugggugaguucgggaaggcuaaaggaucccgggccauaugguacauguggcucggcgcgagauuccuggaauuugaggcauugggcuucaugaaugaggaucacugguuuagcagggaaaacucucugucagggguggagggagaaggucuccauaagcuuggcuacauccugcgcgacauuaguaaaauccccgggggaaauauguaugccgaugacaccgcuggcugggauacgagaauuaccgaggacgauuuacaaaacgaggccaagaucacagacauaauggaaccugagcacgcacuguuggcuacuuccaucuucaaacucaccuaccagaauaaggucgugcggguacagaggccagccaaaaacgguacaguuauggaugugauuagccgucgagaccagcgcgggucuggacaagucggcacuuauggccugaacaccuuuacgaauauggaagugcagcuaaucagacagauggagucggaagggauuuuccuucccucagagcuggagacaccgaaccucgcugaacgggugcugaauugguuggagaagcacggagccgaaagguuaaagcgcauggcaaucagcggugacgauugugucguuaaaccuauagacgauagauuugcgaccgcccugacugcucucaacgacaugggcaaggugcggaaagauauuccccagugggagccauccaagggguggaaugacuggcaacagguaccuuucugcagucaucacuuucaucagcuuaucaugaaagauggaagggaaaucgugguccccugucgaaaccaggacgagcuggugggccgugccagaguuucucaaggugcaggguggagccuacgcgagacagcuugccugggaaaguccuacgcccagauguggcagcucauguauuuccaccggagggauuugagacuggcagccaaugcgauuuguucagcugugccagucgacugggugcccaccagucgcacuaccuggucuauacacgcccaucaccaauggaugacaacggaagauaugcuuagcguauggaaccggguuuggaucgaggaaaauccuuggauggaggacaagacccauguguccucaugggaagaggucccauaccugggcaaaagggaggaccaguggugcggcagccucauuggguuaacugcacgagccacaugggcuaccaacauccagguggccauuaaucagguuagacggcugaucggaaacgaaaauuauuuggauuacaugacuucuaugaagagguuuaaaaacgaguccgacccggaaggugcacugugguga

SEQ ID NO: 13392 - RNA, 9879 nt, Artificial Sequence
  derived and/or modified CDS sequence (opt3) from DENV-1__KJ189368__SS-prME
agcgugaccaugcugcucaugcuucugcccaccgcauuggcuuuccacuuaacuacgagaggcggggaaccucauaugaucgucuccaagcaggaaaggggaaagucucuguuguuuaagaccucagccgguguuaacaugugcacacucauugccauggaccugggcgaacuuugugaagauacuaugaccuacaaaugcccacagauaacagaggcggaaccggacgauguggacuguuggugcaaugcuaccgauacuuggguaacauaugggaccuguagucagaacggagagcaccggcgcgacaagcgaagcguggcccuggcaccccaugucggcuugggucucgagacgcguacugaaaccuggauguccucugagggggccuggaaacagauccagagaguggaaacaugggcucugaggcacccuggauucacuguuauugcacuguuucucgcccaugcuaucggcaccucgauuacacaaaagggcaucauauucaucuuacugaugcuugugaccccaucaauggccaugcggugcgucgggauuggaaaucgcgauuuuguggaggguuugagcggcgcgacguggguugacguugugcuggagcacgggaguugugucacuacaauggcaaagaacaaacccacccuagauaucgaacuccugaagacugaggugacaaauccugccauucuuagaaaacugugcaucgaagcuaagauauccaacaccacgaccgacucuagguguccaacacagggagaggccacuuugguggaagaacaggaugcaaauuucgucugccggcgcaccuuuguugaccgaggcugggguaacggguguggacucuucggcaaaggcagccuguuaacaugcgcuaaguuuaagugcgugacuaaacuggaggggaagauuguacaguacgaaaaucucaaauauuccgugaucgucaccgugcacacaggagaucaacaucagguugguaacgagaccacugaacacggcacgauugccacaaucacaccccaggcgccuacuucagagauccagcuuaccgacuacggggcccugacauuggacuguaguccaagaaccggacuagauuucaaugaaauggugcugcucacuaugaaggagaaaagcuggcugguccauaagcaaugguuucuugaccugccguugcccuggacaucuggcgcauccacgucacaggagaccuggaacaggcaggaucuccuggugacuuucaaaacagcucacgccaagaagcaagaaguaguuguguuagguagccaggagggggcuaugcacaccgcccugacaggcgcaacugaaauucagaccaguggaacgaccacaauauuugccggccaucuaaaaugccggcucaagauggacaaacugacucuuaaggggaccucuuaugucauguguacaggaccuuucaaauuggagaaggaaguggcugagacucagcacgguaccguccuggugcaaguuaaguacgagggcacggaugcgccaugcaaaauccccuucuccacacaggacgaaaagggggugacccagaauggacgucucauuacugcaaacccuaucguaacagauaaagagaagccagucaauauagaaaccgagcccccguuuggcgagagcuauauugugguuggugccggggaaaaagcucugaaacuuucgugguucaagaaaggaucuuccaucggaaagauguuugaggccacugcacgcggcgccagaaggauggcuauccugggggacaccgccugggauuucggaucaauugguggcguguuuacaagugucgggaaauuggugcaucagguauucggaacggcauacggcgugcucuuuagcgguguuuccuggaccaugaagaucgggauuggcauacuguuaacuuggcugggacuaaacucucggagcacaucacucaguaugaccuguaucgcggucggcauggugacacuguaccuuggggugaugguccaagcugacuccggaugcguuauuaacuggaaaggccgagaauugaagugugguagcgggaucuucgugacuaaugaggugcacaccuggacggaacaguauaaguuucaggccgauucuccuaaacgccugucagcagccaucggaaaggcuugggaggagggcguaugcgguauuagaagugccacaaggcucgaaaacauaauguggaaacagaucagcaaugagcugaaccauauuuuacuggaaaaugacaugaaguucaccgucgugguuggcgacgcaaacgggauccuugcucaaggcaagaagaugauucggccccagccaauggagcacaaauacuccuggaagucuuggggcaaggccaaaaucauaggggcggauauccagaauacuaccuuuauuaucgacggaccugauacacccgaauguccagacaaccagcgcgccuggaauauuugggagguggaggauuauggcuucgguaucuuuacuaccaacauaugguugaagcucagagacucguacacacaaaugugcgaucacaggcugaugagcgcugcaauuaaagacuccaaggccguccaugcugauaugggguauuggaucgaaucagagaaaaaugaaacguggaagcuagcccgugcaaguuucauugaggugaagaccuguacuuggcccaaaucucacacacuguggagcaacggaguucucgaauccgagaugaucauaccuaagaucuacggcgguccaauuucacagcauaauuaucggccgggcuacuucacccagacugcggggcccuggcaccugggaaaacuugaguuggacuuugaucugugcgaaggcacaaccgugguagucgacgagcacugcgggaaccgaggaccuagcuuaagaacgacuaccgugacaggcaagaucauucaugaaugguguugcaggucuuguacccucccaccccugcgcuuccggggugaggaugggugcugguacggaauggagaucagaccugugaaagaaaaggaggaaaaucuugucagguccaugguuagugccggcagcggugagguggacucuuuuucccugggcauauuguguguaucaauuaugaucgaagaggugaugcgcagucgauggagccggaagaugcucaugacugggacacuggcugucuuccuacugcucgugaugggacaacugaccuggaacgaccuuauccguuugugcauuaugguuggcgccaacgcaucggauagaauggggaugggaacaacuuaucuggcuuuaauggccaccuuuaaaaugaggccaauguucgcagugggccuccuguuucgccggcuuacguccagagagguccugcuacucacaaucggucugucuuugguggccagcguugaacugcccaauucauuagaggaacucggggacggacuggcuaugggcauuaugaugcuuaagcuguugaccgaguuccagccgcaccagcucuggacuacccugcuaagucugacauuuauaaaaacuacccuuucccucgauuacgcguggaagacgacagccauggcacugucuaucgugagcuuguucccucuguguuuauccaccacuucacagaaaacaaccuggcucccaguccugcuuggcagcuuugggugcaagccccugacuauguucuugauuacagaaaacaagaucuggggaaggaaaaguuggccucucaaugaggguauuauggcuaucggcauaguaucuauccugcuauccagccugcuuaagaacgacgugccccucgccgggccacugauugccggaggcauguugaucgcuuguuauguuauuucggguucaucugcagauuuaagucuggagaaagccgcggaaguguccugggagcaagaagcugagcauagcgggaccucucacaauauccucgucgaagugcaggacgauggaacgaugaagauaaaagacgaggagcgagaugacacucugaccauucuucugaaggccacauugcuagcaguaagcggcguguacccuauguccauccccgccacccuguuugucugguauuucuggcagaaaaagaagcagcgcucaggcguucucugggauacaccaaguccgccugaaguggagcgggcugugcuggacgaugggaucuacaggauucuucaacgaggauuacugggucguagccaggucggcguggggguuuuccaggacggaguauuucauacuauguggcacgugacccgcggcgcaguccucauguaucaggguaaacgguuggaacccucuugggccuccgugaagaaagaccugauaucauacgggggaggcuggagauuccaaggcaguuggaacacgggggaggagguucaggugaucgcggucgaaccaggaaagaaucccaaaaacgugcagacaacuccugguaccuuuaagacaccagagggcgaaguaggggcuauugcccucgauuucaagcccggaaccagcggcuccccuaucgucaauagggaggguaaaauuguggggcuguacggaaacggcguugugacuaccucuggcacauaugucucggcaaucgcccaagcuaaggccagccaggaagggccgcuuccagagauagaggacgaaguguuuaaaaagcgaaaucugacgaucauggauuugcaccccggaucagguaaaacucggcgcuaccuaccugcaauuguuagagaggcuaucaagaggaagcugcggacccucauuuuagccccaacacgaguggucgcguccgaaauggccgaggcacugaaaggcaugcccaucagauaucagaccacugcugugaagagugaacauacagggcgcgagauaguagaccuuaugugccacgccaccuucacgaugaggcugcucucuccugugcguguuccgaacuacaauaugauuaucauggaugaggcucauuuuacugaccccgcaagcaucgccgcccggggauauauuuccacaagagucggcaugggugaagcugcggcaaucuucaugaccgccaccccaccugggucaguggaggcuuuuccccagucuaacgccgugauacaagaugaagagagggacauuccagaacgcagcuggaauaguggauacgauuggaucacugacuucccuggcaaaacagucugguuuguacccuccauuaagagcggcaacgauaucgcaaacuguuugagaaagaaugggaagagagugauacagcugucucggaagaccuucgacacagaguaucagaaaacuaagaacaaugacugggauuacguugugacgaccgacauuucagagaugggagccaacuucagggcugaucgcgucaucgacccacguagaugccucaaaccggugauccugaaggaugguccugaacggguuauucuugcgggccccaugccagugacagucgccuccgcagcucagaggcgcgggcgaaucggaagaaaucaaaacaaagagggcgaccaguacguguauaugggucagccccuaaauaacgaugaagaccacgcccauuggacugaggcaaagaugcuguuggauaauauuaacaccccugaggggauaaucccagccuuauuugaacccgagcgggaaaagagugcugccauugacggcgaguacaggcugcgcggagaagcgagaaaaacauucguagagcucaugaggcggggcgaucugccuguguggcuuagcuauaagguugcaucggagggguuucaguacucugaccgucgcuggugcuucgauggagaacgaaauaaccaaguccuggaggaaaauauggacguggagaucuggaccaaagaaggugagagaaagaaacucaggccgcggugguuggacgcccgcacuuauuccgauccacuggcucuaagagaguuuaaggaguucgccgcuggcaggcggagcaucucaggggaccugauucucgagauaggaaaacuuccccagcaccugacguuacgagcacagaacgccuuggauaaucuggugaugcuccacaacagugaacagggcgguaaggcuuacagacaugccauggaggaacugccugacaccaucgagacacuuaugcugcucgcauugauugcgguccugacugggggcguuaccuuauuuuuccuaucuggaaagggccuggggaaaacauccaucggacuccuuugugugaccgccagcucagcucuguuguggauggccaguguagagccccacuggauugcagcuagcaucauacuggaauuuuuccucauggugcugcuuaucccagagccugaucgccaaaggacuccccaggacaaccagcucgccuaugucgugauuggucuguuguuuaugauccugacaguugcagccaaugaaaugggcuuacuagagacgaccaagaaagaucuggggauuggacauguggcugcggagaaccaccaacacgccacuaugcucgacgucgaucuucggccagcauccgcuuggacacuguacgccguagccaccaccgugaucacaccuaugaugcgucauacuauagaaaauacgaccgcaaacauuucuuugacagcuaucgccaaucaggcggcuauucugaugggccucgacaaggguuggccgaucagcaaaauggauauagggguuccccugcuugccuuaggcugcuacucccaggugaacccacugacucucaccgcagccgucuugaugcugguggcucacuaugcaaucauuggaccuggccuacaggccaaggcgacaagagaggcucaaaagaggaccgccgcagggaucaugaaaaaucccacugucgacggaauuguggccaucgaucuggacccaguuguguacgacgcuaaguucgaaaaacagcucggccagauaaugcuucugauuuuguguacgucacagauccugcucaugcgcacaaccugggcccugugcgagucuaucacuuuagcaaccgguccucuuacaacucugugggaagggagucccggaaaguuuuggaacaccacaauugcuguaucgauggccaauaucuuccggggcagcuaucucgcgggugccggccuagcauucucccugaugaaaucucuagggggaggccgaagagggacgggagcucaaggcgagacccugggugagaaguggaagaggcagcucaaccagcuuucaaaaagcgaauuuaauacuuacaagcgcuccgggauaauggagguggaucggagugaagccaaagagggacugaagagaggcgaaacaaccaaacaugcagucucucgugguacugcuaaguugaggugguucguugagcggaaccuggugaagccggagggcaaagucauugaccucggguguggacgcggcggguggagcuauuacugcgccggauuaaagaaagugacagaaguaaagggcuauaccaaaggugggccaggacacgaggaaccuauccccauggccacguacggcuggaaucuggugaaacuucauucaggcaaagauguauuuuucaugccacccgagaagugugacacccugcuaugcgauauuggggaauccaguccuaacccgacaaucgaggagggacgaacucucagagugcugaagauggucgaacccugguugagggguaaucaguuuuguauaaaaauccugaacccauacaugccuagcguggucgagacccucgaacaaaugcagcggaagcacggcgggaugcuugugcgcaauccccugucuagaaacuccacacacgagauguauuggguuucaugcggaacuggcaacauuguaagcgcggugaauaugaccucgaggauguuacugaaccgauucacaauggcucaucggaaaccuaccuacgagcgugacgucgauuugggugcagggacuagacacguggccguugaaccagagguggcuaaucucgacaucauuggacagcgcaucgaaaacauuaagaaugagcauaaaucuacguggcacuaugaugaagacaaccccuacaagacaugggccuaucacggcaguuacgaggucaagccuuccggcagcgcaucauccauggugaaugggguagugaggcugcuaaccaaaccaugggauguuauccccauggucacucaaauagccaugaccgacacaacgccguuuggacagcagcggguguucaaggagaaaguggacaccagaacuccucgcgcuaagagggguacaacccagauuauggaagucacugcgaaauggcuuuggggcuuucugucucgaaacaagaagccacggaucuguacaagagaggaguucaccaggaaaguucgcagcaaugccgcaaucggggcuguguuuguagaugagaaccaauggaauagugccaaggaagcaguggaggacgagcguuucugggaucucguccaucgggaaagagagcugcacaaacagggaaagugcgccacaugcguguauaacaugaugggcaaaagggaaaagaaguugggugaguuugggaaagcuaagggaucccgcgccauuugguacauguggcugggcgcgcgauuccucgaguucgaggcacuuggcuuuaugaaugaggaccauugguucagccgggaaaacucucugucagggguugagggagaagguuuacacaaacugggcuacauauugagagauaucaguaagauucccgggggaaauauguaugccgacgauacugcuggcugggacaccaggaucacggaggaugaccuccagaacgaggccaaaauuaccgaauuuauggagccugaacaugcacugcuagcuacauccaucuucaaacuuacuuaccagaacaaagugguccgcgugcaaagaccagccaagaaugguaccguaauggauguuauaagccggagggaccagcgugggucuggacaggugggcacauauggccugaacacuuuuaccaauauggagguccagcucauccgacaaauggaaucggaggggauuuuccugcccucagaguuggaaacgccgaacuuagcugagcgcguguuugauuggcuggaaaagcacggagccgagagacucaaacggauggcaaucagcggugacgacuguguggucaagccuauugaugacagguucgcgacagcccuuaccgcucugaaugauaugggcaaaguucgcaaggacaucccccagugggaaccauccaaaggguggaacgauuggcaacaggugccuuuuugcagucaccauuuccaccaacuaauaaugaaggacggaagagagauuguagugcccugucggaaucaggaugagcuggucggcagggcccgagugucucagggugcaggguggagccuccgugaaacugcuugcuugggaaaguccuacgcccaaauguggcagcugauguauuuucauagacgcgaccuucggcuggcagccaacgcgaucuguucagcuguuccaguggauuggguccccacaaguaggaccacuuggucuauccacgcccaccaucaguggaugaccacagaggacaugcucagcguguggaauagaguauggauugaagagaacccuuggauggaagauaaaacgcacguuuccucaugggaggaggugccauacuuaggcaagcgcgaagaccaguggugcggcagccugauaggguugaccgcacgggccacuugggcuacaaauauccaagucgccauuaaccaggugaggcgacugaucggaaaugagaacuaucucgacuacaugaccucuaugaaaagauucaagaaugaauccgauccggagggugcacuuugguga

SEQ ID NO: 13393 - RNA, 9879 nt, Artificial Sequence
  derived and/or modified CDS sequence (opt3) from DENV-1__KJ189369__SS-prME
agcgugaccaugcugcucaugcuucugccaacagcauuggcuuuccacuuaacuacgagaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauuguguguaaguauuaugaucgaagaggugaugcgcagccgauggucgcggaagaugcucaugacagggacccuggcugucuuccuacugcucgugaugggacaacugacauggaaugaccuuauccguuugugcauuaugguuggcgccaacgcauccgauagaauggggaugggaacuaccuaucuggcuuuaauggccacguuuaaaaugaggccuauguucgcagugggccuccuguuucgccggcuuacaucuagagagguccugcuacucaccaucggucugagcuugguggccucaguugaacugccaaacaguuuagaggaacucggggacggacuggcuaugggcauuaugaugcuuaagcuguugacugaguuccagccccaccagcucuggaccacacugcuaucccugacuuuuauaaaaaccacgcuuucucucgauuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaauaagaucuggggaaggaaaucuuggccccucaacgaggguauuauggcuaucggcauaguauccauccugcuaagcucgcugcuuaagaaugacgugccucucgccgggccccugauugccggaggcauguugaucgcuuguuauguuauuucagguucuagugcagauuuaucccuggagaaagccgcggaagugagcugggagcaagaagcugagcauucugggacgagccacaacauccucgucgaagugcaggacgauggaacuaugaagauaaaagacgaggagcgagaugacacccugacaauucuucugaaggccaccuugcuagcaguauccggcguguacccaaugucaaucccugccacacuguuugucugguauuucuggcagaaaaagaagcagcgcaguggcguucucugggauacucccagcccaccggaaguggagcgggcugugcuggacgaugggaucuacaggauucuucaacgaggauuacugggucguucucaggucggcguggggguuuuccaggacggaguauuucauaccauguggcacgugacgcgcggcgcaguccucauguaucaggguaaacgguuggaaccuuccugggccucagugaagaaagaccugauaaguuacgggggaggcuggagauuccaaggcagcuggaauacaggggaggagguucaggugaucgcggucgaacccggaaagaaccccaagaaugugcagacuacccccgguacauuuaagaccccugagggcgaaguaggggcuauugcccucgauuucaagccaggaacuuccggcucucccaucgucaacagggaggguaaaauuguggggcuguacggaaauggcguugugaccacaucgggcacguaugucagcgcaaucgcccaagcuaaggccucacaggaagggccucuuccggagauagaggacgaaguguuuaaaaagcgaaaccugacuaucauggauuugcacccaggauccgguaaaacccggcgcuaccuacccgcaauuguuagagaggcuaucaagaggaagcugcggacacucauuuuagccccuacccgaguggucgcgagugaaauggccgaggcacugaaaggcaugccaaucagauaucagacuacagcugugaagucugaacauaccgggcgcgagauaguagaccuuaugugccacgccacguucacuaugaggcugcucagccccgugcguguuccuaauuacaacaugauuaucauggaugaggcucauuuuacagacccggcauccaucgccgcccggggauauauuucaaccagagucggcaugggugaagcugcggcaaucuucaugaccgccacucccccagggucuguggaggcuuuuccucagagcaaugccgugauacaagaugaagagagggacauucccgaacgcaguuggaacuccggauacgauuggaucacagacuucccaggcaaaaccgucugguuuguaccuagcauuaagucuggcaaugauaucgcaaacuguuugagaaagaacgggaagagagugauacagcugucacggaagacauucgacacugaguaucagaaaacgaagaauaacgacugggauuacguugugaccacagacauuuccgagaugggagccaauuucagggcugaucgcgucaucgacccccguagaugccucaaaccagugauccugaaggaugguccggaacggguuauucuugcgggcccuaugcccgugacugucgccagugcagcucagaggcgcgggcgaaucggaagaaaccaaaauaaagagggcgaccaguacguguauaugggucagccacuaaacaaugaugaagaccacgcccauuggaccgaggcaaagaugcuguuggauaacauuaauacacccgaggggauaaucccugccuuauuugaaccagagcgggaaaagaacgcugccauugacggcgaguacaggcugcgcggagaagcgagaaaaaccuucguagagcucaugaggcggggcgaucugcccguguggcuuagcuauaagguugcaucggagggguuucaguacucugaccgucgcuggugcuucgauggagaacgaaauaaccaaguccuggaggaaaauauggacguggagaucuggacuaaagaaggugagagaaagaaacucaggccucggugguuggacgcccgcacguauuccgauccgcuggcucuaagagaguuuaaggaguucgccgcuggcaggcggagcgugucaggggaccugauccucgagauuggaaaacuuccacagcaccugaccuuacgagcacagaacgccuuggauaaucuggucaugcuccacaacagugaacagggcgguaaggcuuacagacaugccauggaggaacugcccgacacaauagagacucuuaugcugcucgcauugaucgcgguucugaccgggggcgugacauuauuuuuccuaucuggaaagggccuggggaaaaccuccauuggacuccuuuguguaacugccagcucagcucuguuguggauggccaguguggagccucacuggaucgcagcuagcauuauccuggaauuuuuccucaugguccugcuuauacccgagccagaucgccaaaggacaccucaggacaaccagcucgccuaugugguuaucggucuguuguuuaugauucugacgguggcagccaaugaaaugggcuuacuagagaccacuaagaaagaucuggggaucggacaugucgcugcggagaaccaccaacacgccacaaugcucgacguagaucuucggcccgcauccgcuuggacccuguacgccguggccaccacaguuauuacuccaaugaugcgucauacgaucgaaaauaccacagcaaacauaucuuugacugcuauugccaaucaggcggcuauccugaugggccucgacaaggguuggccuauuagcaaaauggauaucggggugccgcugcuugccuuaggcugcuacucccaggucaacccccugacccucacagcagccguguugaugcuggucgcucacuaugcaauaaucggaccaggccuacaggccaaggcgaccagagaggcucaaaagaggacugccgcagggauuaugaaaaauccuacgguggacggaaucguugccauugaucuggaccccgugguauacgacgcuaaguucgaaaaacagcucggccagaucaugcuucugauauuguguacaucacagauucugcucaugcgcaccacuugggcccugugcgagucuaucaccuuagcaacagguccacuuacuacccugugggaagggaguccuggaaaguuuuggaacacaacgaucgcugugucgauggccaauauuuuccggggcagcuaucucgcgggugccggccuagcauucucccugaugaaaucucuagggggaggccgaagagggaccggagcucaaggcgagacucugggugagaaguggaagaggcagcucaaccagcuuucaaaaagcgaauuuaauacauacaagcgcuccgggaucauggaggucgaucggagugaagccaaagagggacugaagagaggcgaaaccacuaaacaugcaguuucucgugguacagcuaaguugaggugguucguggagcggaaccuggucaagcccgagggcaaagugauagaccucggguguggacgcggcggguggagcuauuacugcgccggauuaaagaaaguaaccgaagugaagggcuauacgaaaggugggccgggacacgaggaaccaauuccuauggccaccuacggcuggaaucugguuaaacuucauucaggcaaagauguguuuuucaugcccccagagaagugugacacacugcuaugcgauaucggggaauccagucccaacccuacuauugaggagggacgaacccucagaguccugaagaugguggaaccgugguugagggguaaucaguuuuguaucaaaauacugaaccccuacaugccaagcgucguggagacacucgaacaaaugcagcggaagcacggcgggaugcuuguucgcaauccucugucuagaaacuccacucacgagauguauuggguaucaugcggaaccggcaacaucgugagcgcggucaauaugacaucgaggauguuacugaaccgauucaccauggcucaucggaaacccacuuacgagcgugacguggauuugggugcagggacgagacacguugccguggaaccugaggucgcuaaucucgacauuaucggacagcgcauugaaaacaucaagaaugagcauaaaucuacauggcacuaugaugaagacaacccauacaagaccugggccuaucacggcaguuacgaggugaagcccuccggcagcgcaucauccaugguaaauggggugguuaggcugcuaacuaaaccuugggaugucauuccaauggugacccaaaucgccaugacagacacgacccccuuuggacagcagcggguguucaaggagaaagucgacacuagaacaccgcgcgcuaagagggguaccacucagauaauggaaguuacagcgaaauggcuuuggggcuuucugucucgaaacaagaagccucggauuuguaccagagaggaguucacaaggaaagugcgcagcaaugccgcaaucggggcuguauuuguggaugagaaccaauggaauagugccaaggaagcagucgaggacgagcguuucugggaucucgugcaucgggaaagagagcugcacaaacagggaaagugcgccacuugcguuuauaacaugaugggcaaaagggaaaagaaguugggugaguuugggaaagcuaagggaucccgcgccaucugguacauguggcugggcgcgcgauuccucgaguucgaggcacuuggcuuuaugaaugaggaccauugguucagccgggaaaacucucugucagggguggagggagaagguuuacacaaacugggcuacauuuugagagauauaaguaagaucccagggggaaauauguaugccgacgauaccgcuggcugggacacgaggauuaccgaggaugaccuccagaacgaggccaaaaucacagaaauuauggagcccgaacaugcacugcuagcuacuuccaucuuuaaacuuaccuaccagaacaaagucgugcgcguacaaagaccugccaagaaugguacaguuauggaugugauaagccggagggaccagcgugggucuggacaggucggcacuuauggccugaacaccuucacgaauauggaggugcagcucauccgacaaauggaaucggaggggauuuuucugccaucagaguuggaaacacccaacuuagcugagcgcgugcuggauuggcucgaaaagcacggagccgagagacuuaaacggauggcaaucagcggugacgacugugucguuaagccgauugaugacagguucgcgaccgcccugacugcucuaaaugauaugggcaaagugcgcaaggacaucccucagugggaacccuccaaaggguggaacgauuggcagcagguaccauuuugcagucaccauuuccaccaacugauaaugaaggacggaagagagauuguggucccuugucggaaucaggaugagcucgugggcagggcccgaguuucucagggugcaggguggagcuugcgugaaacagcuugccugggaaaguccuacgcccaaauguggcagcuuauguauuuucauagacgcgaccugcggcucgcagccaacgcgaucuguucagcugugcccgucgauugggugccaaccaguaggacuaccuggucuauccacgcccaccaucaguggaugacaacggaggacauguuaagcguauggaauagaguuuggauugaagagaaccccuggauggaagauaaaacccacguguccucaugggaggaggucccuuaccugggcaagcgcgaagaccaguggugcggcagcuugauagggcugacugcacgggccacaugggcuaccaauauccaaguggccauuaaccagguuaggcgacucaucggaaaugagaacuaucuugacuacaugacuucuaugaaaagauucaagaaugaauccgauccagagggugcacugugguga

SEQ ID NO: 13394 - RNA, 9879 nt, Artificial Sequence
  derived and/or modified CDS sequence (opt3) from DENV-1__EU482615__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauaauggagguagaucggucugaagcaaaagagggacugaagagaggcgaaaccacuaaacaugcugugagccgugguacagccaaguugaggugguucgucgagcggaaucugguuaagcccgagggcaaagugauugaccucggguguggacgcggcggguggucauauuacugcgccggauuaaagaaagucaccgaagugaagggcuauacgaaaggugggccgggacacgaggaaccaaucccuauggcgaccuacggcuggaaccugguaaagcuucauuccggcaaagauguguuuuucaugcccccagagaagugugacacacugcuaugcgauauuggggaaaguagccccaauccuacuaucgaggagggacgaacccucagaguucugaagaugguggaaccgugguugagggguaaccaguuuuguauaaaaauccugaaucccuacaugccaucugucguggagacacucgaacaaaugcagcggaagcacggcgggaugcuuguccgcaacccucuguccagaaauucaacucacgagauguauugggugagcugcggaaccggcaacauuguuucggcuguaaacaugacaucuaggauguuacugaaucgauucaccauggcacaucggaaacccacuuacgagcgugacguggauuugggugccgggacgagacacgucgcuguggaaccugagguugccaaccucgacaucauuggacagcgcaucgaaaauauuaagaacgagcauaaaaguacauggcacuaugaugaagacaauccauacaagaccugggcauaucacggcuccuacgaggugaagcccagcggcucagccuccucuauggucaacggggugguaaggcugcuaacuaaaccuugggaugugaucccaaugguuacccaaauagcuaugacagacacgacccccuuuggacagcagcgggucuucaaggagaaaguggacacuagaacaccgcgcgcgaagagggguaccacucagauuauggaagugacagccaaauggcuuuggggcuuucugagccgaaauaagaagccucggaucuguaccagagaggaauucacaaggaaaguccgcaguaacgcagcuaucggggccguuuuuguggaugagaaucaauggaacuccgcaaaggaagccguagaggacgagcguuucugggaucucgugcaucgggaaagagagcugcacaaacagggaaagugcgcuacuugcgucuauaauaugaugggcaaaagggaaaagaaguugggugaguuugggaaagccaagggaagccgcgcgauuugguacauguggcugggcgcacgauuccucgaauucgaggcccuuggcuuuaugaacgaggaccauugguucucucgggaaaauucacugagugggguggagggagaagguuuacacaaacugggcuacauauugagagauaucuccaagauuccagggggaaacauguaugcugacgauaccgccggcugggacacgaggaucaccgaggaugaccuccagaaugaggcaaaaauuacagauaucauggaacccgagcaugcucugcuagccacuagcauauuuaagcuuaccuaccagaacaaaguugugcgcguccaaagaccugcuaagaacgguacagugauggacguaaucucucggagggaucagcgugggucgggacagguuggcacuuauggccugaauaccuucacgaacauggaagugcagcucauucgacaaauggagucagaagggaucuuucugccaagcgaguuggagacacccaauuuagccgaacgcguccuggacuggcucgagaagcacggagcagaaagacuuaaacggauggcgauuuccggugacgauuguguggugaagccgaucgacgauagguucgccaccgcucugacugcccuaaacgacaugggcaaaguccgcaaggauauaccucagugggagcccaguaaaggguggaaugacuggcagcagguuccauuuugcucucaccauuuccaccaacugauuaugaaggauggaagagaaaucgugguaccuugucggaaccaggacgagcucgugggcagggcacgagucagccagggugcugggugguccuugcgugagacagccugccugggaaagucauacgcacaaauguggcagcuuauguauuuucauagacgcgaucugcggcucgccgcgaaugcuaucuguagugccgugcccguugacugggugccaaccucuaggacuaccuggagcauucacgcacaccaucaguggaugacaacggaagauauguuauccgucuggaacagaguguggauagaggaaaaucccuggauggaggacaaaacccacguaucaagcugggaagagguuccuuaccugggcaagcgcgaggaccaguggugcggcucuuugaucgggcugacugcccgggcuacaugggccaccaacauucaaguggcaaucaaucaggucaggcgacucauuggaaacgaaaauuaucuugauuacaugacuuccaugaaaagauucaagagugagagcgacccagaaggugcucugugguga

SEQ ID NO: 13395 - RNA, 9879 nt, Artificial Sequence
  derived and/or modified CDS sequence (opt3) from DENV-1__EU482616__SS-prME
agcgugaccaugcugcucaugcuucugcccacagcauuggcuuuccacuuaacuacgagaggaggggaaccucauaugaucgucaacaagcaggaaaggggaaaaucccuguuauuuaagaccucugccgguguuaauaugugcacacucauugccauggaccugggcgaacuuugugaagauacuaugaccuacaaaugcccacaaauaacagaagcggaaccggacgauguggacuguuggugcaacgcuaccgauacuuggguaacauaugggaccuguucacagacgggagagcaccggcgcgacaagcgaaguguggcccuggcaccccaugucggcuugggucucgagacucguaccgaaacauggaugagcuccgagggggccuggaaacagauccagagaguggaaacuugggcucugaggcacccuggauucaccguuauugcacuguuucucgcccaugcuaucggcacaucuauuacccaaaagggcaucauauucaucuuacugaugcuugugacgccaucgauggccaugcggugcgucgggauuggaaaucgcgauuuuguggaggguuugucaggcgcgacuuggguagacguugugcuggagcacgggagcugugucacaaccauggcaaagaacaaacccacuuuggauaucgaacuccugaagacagaggugaccaauccugccauucuuagaaaacugugcaucgaagcuaagauaaguaacacgaccacagacuccagguguccaacucagggagaggccaccuugguggaagaacaggaugcaaauuucgucugccggcgcacauuuguugaccgaggcugggguaacggguguggacucuucggcaaaggcucucuguuaacuugcgcuaaguuuaagugcgugaccaaacuggaggggaagauuguacaguacgaaaaucucaaauauagcgugaucgucacagugcacaccggagaucaacaucagguugguaacgagacuacggaacacggcacaauugccaccaucacuccccaggcgccuaccuccgagauccagcuuacagacuacggggcccugaccuuggacuguucaccaagaacuggacuagauuucaaugaaauggugcugcucacaaugaaggagaaaaguuggcugguccauaagcaaugguuucuugaccugccguugcccuggacgagcggcgcaucuaccucccaggagacuuggaacaggcaggaucuccuggugacauucaaaaccgcucacgccaagaagcaagaaguaguuguguuagguucacaggagggggcuaugcacacagcccugacuggcgcaaccgaaauucagacgagcggaaccacaacuauauuugccggccaucuaaaaugccggcucaagauggacaaacugacccuuaaggggacaaguuaugucauguguacuggaucuuucaaauuggagaaggaaguggcugagacccagcacgguacgguccuggugcaaguuaaguacgagggcacagaugcgccuugcaaaaucccauucuccacccaggacgaaaagggggugacucagaauggacgucucauuacagcaaaccccaucguaaccgauaaagagaagccugucaauauagaaacugagccacccuuuggcgagagcuauauugugguuggugccggggaaaaagcucugaaacuuucgugguucaagaaaggaucuuccaucggaaagauguuugaggccaccgcacgcggcgccagaaggauggcuauccugggggacacagccugggauuucggaucaauugguggcguguuuacgagugucgggaaauuggugcaucagguauucggaaccgcauacggcgugcucuuuagcgguguuuccuggacuaugaagaucgggauuggcauacuguuaacauggcugggacuaaacucucggagcaccucacucaguaugacauguaucgcggucggcauggugacucuguaccuuggggugaugguccaagcugacuccggaugcguuauuaacuggaaaggccgagaauugaagugugguagcgggaucuucgugaccaaugaggugcacacguggacagaacaguauaaguuucaggccgauucuccgaaacgccugucagcagccaucggaaaggcuugggaggagggcguaugcgguauuagaagugccaccaggcucgaaaacauaauguggaaacagaucagcaaugagcugaaccauauuuuacuggaaaaugacaugaaguucacugucgugguuggcgacgcaaacgggauccuugcucaaggcaagaagaugauucggccucagcccauggagcacaaauacuccuggaagucuuggggcaaggccaaaaucauaggggcggauauccagaauaccacauuuauuaucgacggaccagauacuccugaaugucccgacgaucagcgcgccuggaacauuugggagguggaggacuauggcuucgguaucuuuaccacaaauauaugguugaagcucagagauucguacacgcaaaugugcgaccacaggcugaugagcgcugcaauuaaagauuccaaggccguccaugcugacaugggguauuggaucgaaucagagaaaaacgaaaccuggaagcuagcccgugcaaguuucauugaggugaagacuuguacauggccaaaaucucacacccuguggagcaauggaguucucgaauccgagaugaucauacccaagaucuacggcgguccuauuucacagcauaacuaucggccaggcuacuucacucagacagcggggccguggcaccugggaaaacuugaguuggauuuugaccugugcgaaggcaccacggugguagucgaugagcacugcgggaaucgaggacccagcuuaagaacuaccacagugaccggcaagaucauucaugaaugguguugcaggucuuguacucucccuccacugcgcuuccggggugaggacgggugcugguacggaauggagaucagacccgugaaagaaaaggaggaaaaccuugucagguccaugguuagugccggcagcggugagguggacucuuuuucccugggcauauugugugcuucaauuaugaucgaagagguaaugcgcagucgauggagccggaagaugcucaugacagggacccuggccguguuccuacugcucaucaugggacaacugacauggaaugaucuuauucguuugugcaucauggucggcgcaaacgcuucggacagaauggggaugggaacuaccuaucuggccuuaauggcaacguuuaaaaugaggccuauguucgccgugggccuccuguuucgccggcuuacauccagagagguucugcuacucaccauuggucugucuuugguggcuagcgucgaacugccaaacucauuagaggaacucggggauggacuggcgaugggcauaaugaugcuuaagcuguugacugaguuccagccccaccagcucuggaccacacugcuaagucugacuuuuaucaaaaccacgcuuucccucgacuacgccuggaagacaaccgcaauggcucugucuauugugagcuuguucccgcuguguuuauccacuacaucacagaaaaccacuuggcucccuguucugcuuggcagcuuugggugcaagccacugacaauguucuugaucaccgaaaauaagauuuggggaaggaaaaguuggccccucaacgaggguaucauggccauaggcaucgugucuauucugcuauccagccugcuuaagaaugaugucccucucgccgggccccugaucgcuggaggcauguugauugcauguuauguaaucucggguucaucugccgacuuaagucuggagaaagcggcugaaguguccugggagcaagaagccgagcauagcgggacgucucacaacauacucguugaagugcaggaugacggaacuaugaagauuaaagaugaggagaaggacgauacccugacaauccuucugaaagcaaccuugcuagccgucagcggcguguacccaauguccaucccugcuacacuguuuguaugguauuucuggcagaagaagaaacagcgaucaggcgugcucugggacacucccaguccaccggaagucgagcgcgcaguucuggaugacgggauuuaccggauacuucaaagaggauuacuggguaggagccaggugggcgugggggucuuccaggacggaguguuucauaccauguggcacguuacgcguggcgccguacucauguaucaggguaagcgcuuggaaccuucuugggcguccgugaaaaaggaucugaucucauacgggggaggcuggcgguuccaaggcaguuggaauacaggggaggagguccaggugauugcuguugaacccggcaagaacccaaagaaugugcagacuacccccgguacauuuaagaccccugagggcgaagucggggccaucgcacucgacuucaaaccaggaacuagcggcucccccauugugaacagagaggguaagaucguagggcuguacggaaauggcgucgugaccacaucuggcacguauguuucggccauagcucaagccaaagcaagccaggaagggccucuuccggagaucgaggaugaaguguuuaagaaaaggaaccugacuauuauggacuugcacccaggaucagguaagacccgacgguaccuacccgcuaucguccgcgaggccauuaagagaaaacugaggacacucaucuuagcgccuacccgggugguugccuccgaaauggcagaggcucugaagggcaugccaauacgauaucagacuacagccgugaaaagugaacauaccgggagagagauugucgaucuuaugugccacgcuacguucacuaugcgccugcucucucccgugaggguaccuaauuacaacaugaucaucauggacgaggcacauuuuacagauccggccagcauugccgcucguggauauaucuccacccgggugggcaugggugaagcggcagccauauucaugaccgcuacucccccagggucaguugaggccuuuccucagucuaaugcagucauucaagacgaagagagagauauccccgaaaggagcuggaacaguggauacgacuggauuacagauuucccaggcaagaccgugugguuugugccuuccaucaaaagcggcaaugacauagccaacuguuugcgcaagaacgggaagcgagucauucagcugucuagaaaaacauucgacacugaguaucagaagacgaaaaauaacgauugggacuacguagugaccacagauaucucagagaugggagcuaauuuccgggcggacaggguuaucgauccccgccguugccucaagccagugauucugaaagacgguccggaaagagucauccuugccggcccuaugcccgugacuguugcauccgcugcccagcggagggggcgcauuggacgaaaccaaaauaaggagggcgaucaguacguguauaugggucagccacuaaacaaugacgaagaucacgcacauuggaccgaggccaagaugcuguuggacaacauaaauacacccgaggggaucauuccugcuuuauuugaaccagagagagagaaaagugccgcgaucgauggcgaguaccggcugaggggagaagcacgcaagaccuucgucgagcucaugagaaggggcgaccugcccguguggcuuagcuauaaaguagccucggagggguuucaguacucugaucggcguuggugcuucgacggagaacgcaacaaucaagugcuggaggaaaacauggacguugagaucuggacuaaggaaggugagaggaaaaagcucagaccuagaugguuggaugcucggacguauuccgacccgcuggcccuacgcgaguuuaaagaguucgcugcaggcagaaggagcgucucaggggaucugauucucgagauaggaaaacuuccacagcaccugaccuuacgggcccagaaugcuuuggacaaccuggugaugcuccacaauagugaacagggcgguaaggccuaccgacaugcaauggaggaacugcccgauacaaucgagacucuuaugcugcucgcguugauugccgugcugaccgggggcgucacauuauuuuuccuaucuggaaaaggccuggggaagaccuccaucggacuccuuuguguuacugcuagcucagcccuguuguggauggcaaguguggagccucacuggauugcugccagcaucauacuggaauuuuuccucaugguacugcuuauccccgagccagacagacaacgcacaccucaggauaaccagcucgcauauguggucauuggucuguuguuuaugauccugacgguggccgcuaacgaaaugggcuuacuagagaccacuaaaaaggaccuggggauuggacauguugcggccgagaaucaccaacacgcaacaaugcucgauguggaccuuaggcccgcuuccgccuggacccuguacgccgucgcaaccacaguaaucacuccaaugaugcggcauacgauagaaaacaccacagcuaauauuucuuugacugccaucgcgaaccaggcugccauucugaugggccucgauaaagguuggccuaucagcaagauggacauaggggugccgcugcuugcauuaggcugcuacucccagguuaauccccugacccucacagccgcuguguugaugcuggucgcacacuaugccaucauuggaccaggccuacaggcgaaggcuacccgugaggcccaaaaacgaacugcagccgggaucaugaagaacccuacgguggauggaauugucgcuaucgaccuggaccccgugguuuacgaugccaaauucgaaaagcagcucggccagauaaugcuucugauuuuguguacaucacagauccugcucaugaggaccacuugggcacugugcgagucuaucaccuuagcuacagguccacuuacuacccugugggaagggaguccuggaaaauuuuggaauacaacgauugccgugucgauggcgaacaucuuccgcggcagcuaucucgccggugcaggccuagcuuucucccugaugaagucucuagggggaggccggcgagggaccggagcccaaggcgagacucugggugagaaguggaaaagacagcucaaucagcuuucaaagagcgaauuuaacacauacaaaagguccgggauaauggagguagaccgcagugaagcaaaggagggacugaaacggggcgaaaccacuaagcaugcugugucuagagguacagccaaguugcguugguucgucgagaggaaucugguuaaacccgagggcaaggugauugaucucggguguggacggggcggguggagcuauuacugcgccggacugaaaaaggucaccgaagugaaaggcuauacgaagggugggccgggacacgaggaaccaaucccuauggcgaccuacggcuggaaccuaguaaaacuucauucaggcaaggacguguuuuucaugcccccagagaagugugauacacugcuaugcgacauuggggaauccagucccaauccuacuaucgaggagggacgcacccuccgaguucugaaaaugguggaaccgugguugagagguaaccaguuuuguauaaagauccugaaucccuacaugccaagcgucguggagacacucgaacaaaugcagaggaaacacggcgggaugcuuguccggaacccucugucucgcaauuccacucacgagauguauugggugucaugcggaaccggcaacauuguuagcgcuguaaacaugacaucgagaauguuacugaauagguucaccauggcacaucgaaagcccacuuacgagcgggauguggacuugggugccgggacgcgucacgucgcuguggaaccugagguugccaaccucgauaucauuggacagagaaucgaaaauauuaaaaacgagcauaagucuacauggcacuaugacgaagauaauccauacaagaccugggcauaucacggcaguuacgaggugaaacccuccggcagcgccucauccauggucaacggggugguacgccugcuaacuaagccuugggacgugaucccaaugguuacccaaauagcuaugacagacacgacccccuuuggacagcagagggucuucaaagagaagguggauacucggacaccgagagcgaaacgcgguaccacucagauuauggaagugacagccaaguggcuuuggggcuuucugucuaggaauaagaaaccucgaaucuguacccgggaggaguucacaagaaaggucaggagcaacgcagcuaucggggccguuuuuguggacgagaaucaauggaacagugcaaaagaagccguagaggaugagcgcuucugggaccucgugcaucgugaacgggagcugcacaagcagggaaaaugcgcuacuugcgucuauaauaugaugggcaagagagaaaagaaauugggugaguuugggaaggccaaaggauccagggcgauuugguacauguggcugggcgcacgcuuccucgaguucgaggcccuuggcuuuaugaacgaggaucauugguucagccgagaaaauucucugucagggguggagggagaagguuuacacaagcugggcuacauauugcgggacaucaguaaaauuccagggggaaacauguaugcugaugacaccgccggcugggauacgagaaucaccgaggacgaucuccagaaugaggcaaagauuacagacaucauggaacccgagcaugcucugcuagccacuuccauauuuaaacuuaccuaccagaacaagguugugaggguccaacgcccugcuaagaacgguacagugauggauguaaucagcagacgggaccagagggggucuggacagguuggcacuuauggccugaauaccuucacgaacauggaagugcagcucauucgucaaauggagucggaagggaucuuucugccaucagaguuggagacacccaauuuagccaaacgaguccuggacuggcucgaaaagcacggagcagagcgccuuaaaagaauggcgauuagcggugaugacuguguggugaagccgaucgaugaccgguucgccaccgcucugacugcccuaaacgauaugggcaaagucaggaaggacauaccucagugggaacccuccaagggguggaaugauuggcagcagguuccauuuugcagucaccauuuccaccaacugauuaugaaagacggacgcgagaucgugguaccuuguagaaaccaggaugaacucgugggccgggcaagggucucucagggugcuggguggagcuugcgagagacagccugccugggaaaguccuacgcacaaauguggcagcuuauguauuuucaucguagagaccugcgccucgccgcgaaugcuaucuguucagccgugcccguugauugggugccaaccagucggacuaccuggucuauucacgcacaccaucaguggaugacaacggaggacauguuaagcgucuggaacaggguguggauagaagagaaucccuggauggaagacaaaacccacguauccucaugggaggaaguuccuuaccugggcaagagagaggaucaguggugcggcagcuugaucgggcugacugcccgcgcuacaugggccaccaacauucaaguggcaaucaaucagguccggaggcucauuggaaacgagaauuaucuugacuacaugacuucuaugaaacgauucaagaacgaauccgauccagagggugcucugugguga

SEQ ID NO: 13396 - RNA, 9879 nt, Artificial Sequence
  derived and/or modified CDS sequence (opt3) from DENV-1__EU482618__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauaauggagguagaucggucugaagcaaaagagggacugaagagaggcgaaaccacuaaacaugcugugagccgugguacagccaaguugaggugguucgucgagcggaaucugguuaagcccgagggcaaagugauugaccucggguguggacgcggcggguggucauauuacugcgccggauuaaagaaagucaccgaagugaagggcuauacgaaaggugggccgggacacgaggaaccaaucccuauggcgaccuacggcuggaaccugguaaagcuucauuccggcaaagauguguuuuucaugcccccagagaagugugacacacugcuaugcgauauuggggaaaguagccccaauccuacuaucgaggagggacgaacccucagaguucugaagaugguggaaccgugguugagggguaaccaguuuuguauaaaaauccugaaucccuacaugccaucugucguggagacacucgaacaaaugcagcggaagcacggcgggaugcuuguccgcaacccucuguccagaaauucaacucacgagauguauugggugagcugcggaaccggcaacauuguuucggcuguaaacaugacaucuaggauguuacugaaucgauucaccauggcacaucggaaacccacuuacgagcgugacguggauuugggugccgggacgagacacgucgcuguggaaccugagguugccaaccucgacaucauuggacagcgcaucgaaaauauuaagaacgagcauaaaaguacauggcacuaugaugaagacaauccauacaagaccugggcauaucacggcuccuacgaggugaagcccagcggcucagccuccucuauggucaacggggugguaaggcugcuaacuaaaccuugggaugugaucccaaugguuacccaaauagcuaugacagacacgacccccuuuggacagcagcgggucuucaaggagaaaguggacacuagaacaccgcgcgcgaagagggguaccacucagauuauggaagugacagccaaauggcuuuggggcuuucugagccgaaauaagaagccucggaucuguaccagagaggaauucacaaggaaaguccgcaguaacgcagcuaucggggccguuuuuguggaugagaaucaauggaacuccgcaaaggaagccguagaggacgagcguuucugggaucucgugcaucgggaaagagagcugcacaaacagggaaagugcgcuacuugcgucuauaauaugaugggcaaaagggaaaagaaguugggugaguuugggaaagccaagggaagccgcgcgauuugguacauguggcugggcgcacgauuccucgaauucgaggcccuuggcuuuaugaacgaggaccauugguucucucgggaaaauucacugagugggguggagggagaagguuuacacaaacugggcuacauauugagagauaucuccaagauuccagggggaaacauguaugcugacgauaccgccggcugggacacgaggaucaccgaggaugaccuccagaaugaggcaaaaauuacagauaucauggaacccgagcaugcucugcuagccacuagcauauuuaagcuuaccuaccagaacaaaguugugcgcguccaaagaccugcuaagaacgguacagugauggacguaaucucucggagggaucagcgugggucgggacagguuggcacuuauggccugaauaccuucacgaacauggaagugcagcucauucgacaaauggagucagaagggaucuuucugccaagcgaguuggagacacccaauuuagccgaacgcguccuggacuggcucgagaagcacggagcagaaagacuuaaacggauggcgauuuccggugacgauuguguggugaagccgaucgacgauagguucgccaccgcucugacugcccuaaacgacaugggcaaaguccgcaaggauauaccucagugggagcccaguaaaggguggaaugacuggcagcagguuccauuuugcucucaccauuuccaccaacugauuaugaaggauggaagagaaaucgugguaccuugucggaaccaggacgagcucgugggcagggcacgagucagccagggugcugggugguccuugcgugagacagccugccugggaaagucauacgcacaaauguggcagcuuauguauuuucauagacgcgaucugcggcucgccgcgaaugcuaucuguagugccgugcccguugacugggugccaaccucuaggacuaccuggagcauucacgcacaccaucaguggaugacaacggaagauauguuauccgucuggaacagaguguggauagaggaaaaucccuggauggaggacaaaacccacguaucaagcugggaagagguuccuuaccugggcaagcgcgaggaccaguggugcggcucuuugaucgggcugacugcccgggcuacaugggccaccaacauucaaguggcaaucaaucaggucaggcgacucauuggaaacgaaaauuaucuugauuacaugacuuccaugaaaagauucaagaacgagagugacccagaaggugcucugugguga

SEQ ID NO: 13397 - RNA, 9879 nt, Artificial Sequence
  derived and/or modified CDS sequence (opt3) from DENV-1__EU482619__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauaauggagguagaucggucugaagcaaaagagggacugaagagaggcgaaaccacuaaacaugcugugagccgugguacagccaaguugaggugguucgucgagcggaaucugguuaagcccgagggcaaagugauugaccucggguguggacgcggcggguggucauauuacugcgccggauuaaagaaagucaccgaagugaagggcuauacgaaaggugggccgggacacgaggaaccaaucccuauggcgaccuacggcuggaaccugguaaagcuucauuccggcaaagauguguuuuucaugcccccagagaagugugacacacugcuaugcgauauuggggaaaguagccccaauccuacuaucgaggagggacgaacccucagaguucugaagaugguggaaccgugguugagggguaaccaguuuuguauaaaaauccugaaucccuacaugccaucugucguggagacacucgaacaaaugcagcggaagcacggcgggaugcuuguccgcaacccucuguccagaaauucaacucacgagauguauugggugagcugcggaaccggcaacauuguuucggcuguaaacaugacaucuaggauguuacugaaucgauucaccauggcacaucggaaacccacuuacgagcgugacguggauuugggugccgggacgagacacgucgcuguggaaccugagguugccaaccucgacaucauuggacagcgcaucgaaaauauuaagaacgagcauaaaaguacauggcacuaugaugaagacaauccauacaagaccugggcauaucacggcuccuacgaggugaagcccagcggcucagccuccucuauggucaacggggugguaaggcugcuaacuaaaccuugggaugugaucccaaugguuacccaaauagcuaugacagacacgacccccuuuggacagcagcgggucuucaaggagaaaguggacacuagaacaccgcgcgcgaagagggguaccacucagauuauggaagugacagccaaauggcuuuggggcuuucugagccgaaauaagaagccucggaucuguaccagagaggaauucacaaggaaaguccgcaguaacgcagcuaucggggccguuuuuauugaugagaaucaauggaacuccgcaaaggaagccguggaggacgagcguuucugggaucucguacaucgggaaagagagcugcacaaacagggaaagugcgcuacuugcguguauaauaugaugggcaaaagggaaaagaaguugggugaguuugggaaagccaagggaagccgcgcgauaugguacauguggcugggcgcacgauuccucgaauucgaggcccuuggcuuuaugaacgaggaccauugguucucucgggaaaauucacugaguggggucgagggagaagguuuacacaaacugggcuacaucuugagagauauuuccaagaucccagggggaaacauguaugcugacgauaccgccggcugggacacgagggugaccgaggaugaccuccagaaugaggcaaaaauuacagauaucauggaacccgagcaugcucugcuagccacuagcauauuuaagcuuaccuaccagaacaaaguugugcgcguccaaagaccugcuaagaacgguacagugauggacguaaucucucggagggaucagcgugggucgggacagguuggcacuuauggccugaauaccuucacgaacauggaagugcagcucauucgacaaauggagucagaagggaucuuucugccaagcgaguuggagacacccaauuuagccgaacgcguccuggacuggcucgagaagcacggagcagaaagacuucggaggauggcgauuuccggugacgauuguguggugaaaccgaucgacgaucgcuucgccaccgcucugacugcccuaaacgacaugggcaaggucagaaaagauauaccucagugggagcccaguaagggguggaaugacuggcagcagguuccauuuugcucucaccauuuccaccaacugauuaugaaagauggacgggaaaucgugguaccuuguaggaaccaggacgagcucgugggccgagcacgugucagccagggugcugggugguccuugagagagacagccugccugggaaagucauacgcacaaauguggcagcuuauguauuuucaucgccgggaucugaggcucgccgcgaaugcuaucuguagugccgugcccguugacugggugccaaccucuagaacuaccuggagcauucacgcacaccaucaguggaugacaacggaagauauguuauccgucuggaaccgcguguggauagaggaaaaucccuggauggaggacaagacccacguaucaagcugggaagagguuccuuaccugggcaaacgggaggaccaguggugcggcucuuugaucgggcugacugccagggcuacaugggccaccaacauucaaguggcaaucaaucagguccgaagacucauuggaaacgaaaauuaucuugauuacaugacuuccaugaagcgguucaaaaacgagagugacccagaaggugcucugugguga

SEQ ID NO: 13398 - RNA, 9879 nt, Artificial Sequence
  derived and/or modified CDS sequence (opt3) from DENV-1__FJ898433__SS-prME
agcgugaccaugcugcucaugcuucugcccacagccuuggcuuuccacuuaacuacgagaggaggggagccucauaugaucgucuccaagcaggaaagaggaaaaucucugcuguuuaagaccucagcugguguuaacaugugcacacucauugccauggaccugggagagcuuugugaagauacuaugaccuacaaaugcccacagauaacagaggcggaaccggacgauguggacuguuggugcaaugcuaccgauacuuggguaacauaugggaccuguagucagacgggagagcaccggcgcgagaagcgaagcguggcccuggcuccccaugucggcuugggucucgaaacucguaccgagacauggauguccucugaaggggccuggaaacagauccagagaguggagacuugggcucugagacacccuggauucaccguuacagcacuguuucucgcccaugcuauuggcaccucgaucacgcaaaagggcauuaucuucauauuacugaugcuugugacuccaucaauggccaugcggugcgucgggaucggaaaccgcgacuuuguggaggguuugagcggcgcgacauggguugauguugugcuggaacacgggaguugugucaccacuauggcaaagaauaaacccacacuagacauugagcuccugaagaccgaagugacgaacccugccauccuuagaaaacugugcauugaggcuaagaucuccaauaccacaacugauucuagguguccaacccagggagaagccacauugguggaggagcaggacgcaaacuucgucugccggcgcacuuuuguugaucgaggcugggguaauggguguggacucuucggcaaaggcagccuguuaaccugcgcuaaguuuaagugcgugacaaaacuggaagggaagauaguacaguacgagaaccucaaauauuccgugauugucaccgugcacacuggagaccaacaucagguugguaaugaaacgacagagcacggcaccaucgccacuauuacaccccaggcgccuacaucagaaauccagcuuaccgauuacggggcccugacuuuggacuguaguccaagaacaggacuagacuucaacgagauggugcugcucacgaugaaggagaaaagcuggcugguccauaagcaaugguuucuugaucugccguugcccuggaccucuggcgcauccacuucacaggaaacauggaauaggcaggaccuccuggugaccuucaaaacagcucacgccaagaagcaagagguaguuguguuagguagccaggaaggggcuaugcacacugcccugaccggcgcaacggagauccagaccaguggaacaacuaccauuuuugccggccaucuaaaaugccggcucaagauggauaaacugacacuuaaggggacuucuuaugucauguguaccggauccuucaaauuggaaaaggagguggcugagacgcagcacgguacaguccuggugcaaguuaaguacgaaggcaccgacgcgccuugcaaaauaccauucagcacucaggaugagaagggggugacacagaacggacgucucaucaccgcaaaucccauuguaacugacaaagaaaagccugucaacaucgagaccgagccacccuuuggcgaaucguauauagugguuggugccggggagaaagcucugaaacuuucuugguucaagaaaggcuccucaauuggaaagauguuugaagccacagcacgcggcgccagaaggauggcuauccugggggauacggccugggacuucggaaguaucgguggcguguuuaccagcgucgggaaauuggugcaucagguauucggaacugcauacggcgugcucuuuuccgguguuucuuggacaaugaagauugggaucggcauucuguuaaccuggcugggacuaaauagccggucaacaagucucuccaugacuuguauagcggucggcauggugacccuguaccuuggggugaugguccaagcugauagcggaugcguuaucaacuggaaaggccgagaguugaagugugguucugggauuuucgugacgaacgaagugcacacauggaccgagcaguauaaguuucaggccgacucaccgaaacgccugagugcagccaucggaaaggcuugggaggaaggcguaugcgguaucagaagcgccacuaggcucgagaauauuauguggaaacagauauccaacgaacugaaucauaucuuacuggagaacgauaugaaguucaccgucgugguuggcgacgcaaaugggauucuugcucaaggcaagaagaugauccggccucagcccauggaacacaaauacucuuggaagucguggggcaaggccaaaauuaucggggcggacauacagaacacaacuuuuaucauugauggaccagacaccccugagugucccgauaaucagcgcgccuggaacaucugggagguggaagacuauggcuucgguauuuuuacaacgaauaucugguugaagcucagagauagcuacacccaaaugugcgaccacaggcugauguccgcugcaauaaaagauucaaaggccguccaugcugacaugggguauuggauugagagugagaagaacgagacuuggaagcuagcccgugcaucuuucaucgaagugaagacauguaccuggccaaaaagccacacucugugguccaauggaguucucgagucagagaugauuauccccaagauauacggcgguccuaucagccagcauaacuaucggccaggcuacuucacacagaccgcggggccguggcaccugggaaaacuugaauuggauuuugacucuugcgagggcacgacugugguagucgaugaacacugcgggaaucgaggacccucccugagaaccacaaccgugacuggcaagauuauccaugagugguguugcaggaguuguacauuaccuccacuccgcuuccggggugaggacgggugcugguacggaauggaaauuagacccgugaaagagaaggaagagaaccuggucaggagcaugguuucugccggcuccggugaaguggauucauuuagucuuggcauccuguguguaagcauaaugauugaggaggugaugcgcucgcgauggucccggaagauguugaugaccgggacacucgcugucuuccugcuacugaucaugggacaacucacuuggaaagaccugauccgucuuugcauuauggugggcgccaaugcaucugacagaauggggaugggaaccacguauuuggcucugauggccacauuuaagaugaggccuauguucgcaguuggcuuacucuuucgccggcugaccagcagagaagugcuucugcuaacuaucggucucucacuggucgccaguguggaguugccaaacucccuggaagaguuaggggauggacucgcuaugggcauuaugaugcugaaacuucugaccgaguuccacccccaucaguuguggacaacucuccugucucuaaccuuuauaaagacgacacugagccuugacuacgcguggaaaaccacugccauggcacucuccaucguuucacuguucccguugugucugagcacaaccagucagaagacuacaugguuaccugugcuccugggcucuuuugggugcaagccacuuaccauguuccugauuacggagaacaaaaucuggggaaggaaguccuggcccuugaaugaggguauuauggcuaucggcauagucagcauccuccugucgucacuacugaaaaacgauguaccucuugccgggccccucauugccggaggcaugcugaucgcuuguuaugugauuucugguaguuccgcagacuugagcuuagaaaaggccgcggagguuucuugggaacaggaggcugaacacagcgggacuucccauaauauccugguggagguccaagaugacggaaccaugaaaauaaaggaugaggaacgagacgauacacucaccauucugcuuaaagccacacuguuggcagugucaggcguauacccaaugaguaucccugccacucuauuugugugguauuucuggcagaagaagaaacagcgcagcggcguccugugggacacccccucuccaccggagguugaacgggcugugcucgaugacgggaucuacaggauucugcagaggggacuuuuaggucguucccaagugggcgucgggguguuccaggauggaguuuuucacacgauguggcacguaacacgcggcgcagugcugauguaucaggguaagcggcucgagccuucaugggccagugucaaaaaggacuugauaagcuacgggggaggcuggagauuccagggcuccuggaacacuggggaggaagugcaaguuaucgcgguggagcccggcaaaaauccaaagaacguccagaccacacccgguaccuuuaagacuccugaaggcgaggugggggcuauugcccuggacuucaaaccaggaaccucuggcucgcccaucguaaauagggaagguaagauugucgggcucuacggaaacggcgugguuacaacgagcggcacuuaugugucagcaaucgcccaggcuaaagccucccaagaggggccucugccggagauagaagaugaggucuuuaagaaacgaaaucuuaccaucauggaccugcauccaggaagugguaagacacggcgcuacuugcccgcaauugugagagaagcuaucaagaggaaacuacggacccugauucucgccccuacucgaguuguggcgucugagauggccgaagcauuaaagggcaugccaaucagauaucagacaaccgcugucaaaagcgagcacacggggcgcgagauaguggaucugaugugccaugccacuuucacaaugaggcuucugucccccguacgugugccuaacuacaauaugauuaucauggacgaagcucacuuuaccgauccggcaucaaucgccgcccggggauauauuucuaccagaguuggcaugggugaggcugcggcaaucuucaugacugccacacccccagggagcgucgaagccuuuccucagaguaacgccgugauacaggacgaggaaagggauauucccgagcgcuccuggaauagcggauacgacuggaucaccgauuucccaggcaagacagugugguuugucccuucuauuaaaucaggcaacgacaucgcaaauugucuccgaaagaacgggaagagaguaauacaauugucccggaaaacuuucgauacggaguaucagaagaccaaaaacaaugacugggacuacgugguuacaacugauauuagugaaaugggagccaacuucagggcugaccgcgugaucgauccccguagaugccugaagccagucauccucaaagacgguccggagcgggugauucuggcgggcccuaugcccguuaccguggccagcgcagcucagaggcgcgggcgaaucggaagaaaucagaacaaggaaggcgaucaauacgucuauaugggucagccacuuaauaacgacgaggaucaugcccacuggacagaggcaaagaugcuacuggacaauauuaacacccccgaagggauaaucccugccuuguuugagccagaacgggagaaaucggcugccauugauggcgaauacagguuacgcggagaggcgagaaagacuuucguggagcugaugaggcggggcgaccuccccguauggcugucuuauaaaguggcauccgaaggguuucaguacagcgaucgucgcuggugcuucgacggagagcgaaauaaccagguucuugaagagaauauggaugucgaaaucuggacgaaggagggugagaggaaaaagcugaggccucgguggcucgacgcccgcaccuauucagacccguuggcucugagagaauuuaaagaguucgccgcuggcaggcggagugugucuggggaucuaauccuggaaauuggaaagcucccacaacaccuuacacugcgagcacagaacgccuuagacaauuuggugaugcugcauaacuccgagcagggcgguaaggcuuacagacacgccauggaagaacuccccgauacuauagagacccugaugcuucuggcacucaucgcggucuugacagggggcguuacccuguuuuucuuaagcggaaaaggccuagggaagacuucaauuggacugcucugugugacagccaguagcgcacuucuguggauggccuccguagaaccucauuggaucgcagcuucuauuaucuuggaguuuuuccugauggugcuccugauacccgaaccagaccgccagaggacgccucaagauaaucagcuugccuaugucgugaucggucuccuguuuaugauuuugaccguugcagccaacgagaugggccuguuagagacuaccaaaaaggaccuagggaucggacacguggcugcggaaaaccaccagcaugccaccaugcuggaugucgaccuccggcccgcaagcgcuuggacccuuuacgccguagccacaacugugauuacgccaaugaugcgucacaccaucgagaauacaacugcaaacauaucccugaccgcuauugccaaucaagcggcuaucuugaugggccuggauaaagguuggccuauuucaaagauggacaucgggguuccgcuccuggcccuuggcugcuacucucaggugaaccccuuaacacugaccgcagccguccucauguugguggcucauuaugcaauaaucggaccaggccugcaggccaaggcgacuagagaagcucagaaaaggacggccgcagggauuaugaagaauccuacagucgauggaaucguggccauugaccuagaucccguuguguacgacgcuaaauucgagaagcaacugggccagaucaugcuccuuauacuguguaccagucagauuuugcugaugcgcacuaccugggcccucugcgaaucgaucacacuggcaacugguccauuaaccacacuuugggaggggagcccuggaaaauuuuggaacacgaccaucgcuguauccauggccaauauuuuccggggcucuuaucuggcgggugccggccucgcauucucacuaaugaaaagccuagggggaggccgaagagggacuggagcucagggcgagacauugggugaaaaguggaaaaggcaacugaaccagcucuccaagagugaguuuaauaccuacaaacgcucugggaucauggaaguggaccggagcgaggccaaggaaggacuuaaaagaggcgagacuacaaagcacgcagucucacgugguaccgcuaagcugaggugguucguugagcggaacuuggugaaacccgaaggcaaggucauagaucugggguguggacgcggcgggugguccuauuacugcgccggacucaaaaaggugacggagguaaaaggcuauaccaagggugggccgggacaugaagaaccaauuccuauggccacauacggcuggaauuuagugaaacugcacaguggcaaggacguauuuuucaugcccccagaaaagugugauacucuucugugcgacaucggggagagcucucccaacccuaccauugaggaaggacgaacacuaagagugcucaaaauggucgagccguggcugagggguaaucaguuuuguaucaagauauugaaccccuacaugccauccguggucgaaacucuggagcagaugcaacggaaacacggcgggaugcucgugcgcaauccucuuucaagaaacagcacccaugagauguauuggguuucgugcggaacaggcaauaucguaucugcggugaacaugaccaguaggaugcuguuaaaccgauucacuauggcucaccggaagcccacguacgaaaaagaugucgaccugggugcagggacacgucauguggccguugagccugaaguggcuaauuuggauauuaucggacagagaauugagaacaucaagaaugaacacaaguccaccuggcacuaugacgaggauaacccauacaaaacuugggccuaucauggcagcuacgaggucaagcccucaggcuccgcaucuagcauggugaaugggguagugcgccuccugaccaaaccuugggacguuauuccaauggucacacagaucgccaugacggauaccacucccuuuggacaacagaggguguucaaggaaaaaguggacacacggaccccgagagcuaagcgcgguacuacacagauaauggaggucaccgcgaaguggcuauggggcuuucuuaguaggaacaaaaagccucgaauuuguacacgggaagaguucacuagaaaaguuagguccaaugccgcaaucggggcuguguuuguagacgaaaaccaguggaauagcgccaaggaggcaguggaggaugaacgcuucugggaccugguccaccgugagcgggaacuccauaaacaaggaaagugcgcaaccugcguguauaacaugaugggcaagagagagaaaaagcugggugaauuugggaaagcuaagggaucuagggccaucugguacaugugguugggcgcgcgcuuccuggaguucgaggcacucggcuuuaugaaugaagaucacugguucucacgagagaacagucuuuccgggguugaaggagagggucugcauaaauuaggcuacauucugcgggacauaagcaagaucccagggggaaauauguaugccgaugacacggcuggcugggauaccagaauuacagaggacgauuugcagaacgaagccaaaaucacugacauuauggagcccgaacacgcacuccuggcuaccucuaucuuuaagcuaacauaccagaauaagguggucagggugcagcgcccugccaaaaacgguacuguaauggauguuauaucgagacgggaccaaagggggucaggacaggugggcaccuauggccuuaacacguucacaaauauggagguccagcugauccgucagauggaaagcgaggggauuuuucucccauccgagcuggaaacccccaacuuggcugagcgaguguuagauuggcugggaaagcacggugccgaacgccucaaaagaauggcaaucaguggcgacgacuguguggucaagccgauugaugaccgguucgcgacugcccuuacagcucugaaugauauggggaaaguuaggaaggacaucccucaaugggagcccucuaagggauggaacgauuggcaacaggugccauuuugcagccaucacuuccaucagcuaauaaugaaagacggccgcgaaauuguagugccuuguagaaaucaagaugagcuggucggucgggccagggugucccagggggcaggauggucacucaaggagaccgcuugcuugggcaaaaguuacgcccagauguggcaacugauguauuuucaccgacgugaccuuagacuggcagccaacgcgaucuguucugcuguucccguggauugggucccaacuagccgcaccacaugguccauccacgcccaucaccaguggaugacgaccgaagacaugcucucaguguggaaucggguauggauugaggaaaaccccuggauggaggauaagacucauguuagcucuugggaagaggugccuuacuuaggcaaaagggaggaccaguggugcgggucccugauaggauugacagcaagagccaccugggcuacuaauauccaggucgccauuaaccaagugcgccggcugaucgguaaugaaaacuaucucgacuacaugacaaguaugaagagguucaagaaugagagcgauccagaaggcgcacuuugguga

SEQ ID NO: 13399 - RNA, 9879 nt, Artificial Sequence
  derived and/or modified CDS sequence (opt3) from DENV-1__FJ547088__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacacaaaguucgaaaaacagcucggccagauaaugcuucugauuuuguguaccucucagauccugcucaugcgcacuaccugggcccugugcgagaguaucacauuagcaacugguccacuuaccacacugugggaagggucgccuggaaaguuuuggaauacgaccauugcugugagcauggccaacaucuuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacauauacaagcgcagugggauuauggagguagaucggucugaagccaaagagggacugaagagaggcgaaaccacuaaacaugcagugagccgugguacagcuaaguugaggugguucgucgagcggaaucugguuaagcccgagggcaaagugaucgaccucggguguggacgcggcggguggucauauuacugcgccggauuaaagaaagucaccgaagugaagggcuauacgaaaggugggccgggacacgaggaaccaauuccuauggccaccuacggcuggaaccugguaaagcuucauuccggcaaagauguguuuuucaugcccccagagaagugugacacacugcuaugcgauaucggggaaaguagccccaauccuacuauagaggagggacgaacccucagaguucugaagaugguggaaccgugguugagggguaaccaguuuuguaucaaaauucugaaucccuacaugccaucugucguggagacacucgaacaaaugcagcggaaguauggcgggaugcuuguccgcaacccucuguccagaaauucaacucacgagauguacugggugagcugcggaaccggcaacaucguuucggcgguaaacaugacaucuaggauguuacugaaucgauucaccauggcucaccggaaacccacuuaugagcgugacguggauuugggugcagggacgagacaugucgccguggaaccugagguugcuaaccucgacauuaucggacagcgcauugaaaauaucaagaacgagcacaaaaguacauggcauuacgaugaagacaauccauauaagaccugggccuaccacggcuccuaugaggugaagcccagcggcucagcauccucuauggucaacggggugguaaggcugcuaacuaaaccuugggaugugauaccaaugguuacccaaauugccaugacagacacgacccccuuuggacagcagcgggucuucaaggagaaaguggacacuagaacaccgcgcgcuaagagggguaccacucagaucauggaagugacagcgaaauggcuuuggggcuuucugagccgaaauaagaagccucggaucuguaccagagaggaauucacaaggaaaguccgcaguaacgccgcaauuggggcuguuuuuguggaugagaaucaauggaacuccgccaaggaagcaguagaggacgagcguuucugggaucucgugcaccgggaaagagagcugcauaaacagggaaagugcgccacuugcgucuacaauaugaugggcaaaagggaaaagaaguugggugaguuugggaaagcuaagggaagccgcgccauaugguacauguggcugggcgcgcgauuccucgaauucgaggcacuuggcuuuaugaacgaggaccacugguucucucgggaaaauucacugagugggguggagggagaagguuuacauaaacugggcuauaucuugagagauauuuccaagaucccagggggaaacauguacgccgacgauaccgcuggcugggacacgaggauuaccgaggaugaccuccagaaugaggccaaaaucacagauauaauggaacccgagcacgcacugcuagcuacuagcaucuuuaagcuuaccuaucagaacaaaguugugcgcguccaaagaccugccaagaacgguacagugauggacguaauuucucggagggaucagcgugggucgggacagguuggcacuuacggccugaauaccuucacgaacauggaagugcagcucauccgacaaauggagucagaagggauuuuucugccaagcgaguuggagacacccaauuuagcuggacgcguccuggacuggcucgaaaagcauggugccgagagacuuaaacggauggcaaucuccggcgacgauuguguggugaagccgauagacgauagguucgcgaccgcccugacugcucuaaacgacauggggaaaguccgcaaggauauuccucagugggaacccaguaaaggauggaaugacuggcagcagguuccauuuugcucucaccacuuccaucaacugaucaugaaggauggcagagagaucgugguaccuugucggaaccaggacgaacucguggguagggcccgagucagccagggggcaggaugguccuugcgugagacagcuugccugggcaagucauaugcccaaauguggcagcuuauguacuuucacagacgcgaucugcggcucgcagccaaugcgauuuguagugcugugcccguugacugggugccaaccucuaggacuaccuggagcauacaugcccaccaccaguggaugacaacggaggauauguuauccgucuggaacagaguguggaucgaagagaaucccuggauggaagacaaaacccauguaucaagcugggaggaaguuccuuaucugggcaagcgcgaggaccaguggugcgggucuuugauuggacugacugcacgggccacaugggcuaccaacauccaaguggccauuaaucaggucaggcgacucaucgguaacgagaauuaccuugauuacaugacuuccaugaaaagauucaagaacgaaagugacccagagggcgcacugugguga

SEQ ID NO: 13400 - RNA, 9879 nt, Artificial Sequence
  derived and/or modified CDS sequence (opt3) from DENV-1__FJ810419__SS-prME
agcgugaccaugcugcucaugcuucugccaacugcauuggcuuuccacuuaacuacgcgaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuugggugacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaaaaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaaccccaagaaugugcagacuacccccgguacauuuaagaccuccgagggcgaagucggggccaucgcacucgauuucaagccuggaacuucuggcucgccaauugugaacagggaggguaaaaucguagggcuguacggaaauggcgucgugaccacaagcggcacguauguuucagccauagcucaagccaaggcaucccaggaagggccccuuccugagaucgaggacgaaguguuuaaaaagcgaaaccugacuauuauggauuugcacccgggaagugguaaaacccggcgcuaccuaccagcuaucgucagagaggccauuaagaggaagcugcggacacucaucuuagcgcccacccgagugguugccucugaaauggcagaggcucugaaaggcaugccuauaagauaucagacuacagccguaaagagcgaacauaccgggcgcgagauugucgaccuuaugugccacgcuacguucacuaugaggcugcucuccccagugcguguacccaauuacaacaugaucaucauggaugaggcacauuuuacagacccugccucaauugccgcucggggauauaucucuaccagagugggcaugggugaagcggcagccauauucaugaccgcuacuccgcccgggagcguugaggccuuuccacagaguaaugcagucauucaagaugaagagagggacaucccugaacgcuccuggaacagcggauacgauuggauuacagacuuccccggcaaaaccgugugguuugugccaucuaucaagucaggcaaugauauagccaacuguuugagaaagaacgggaagagagucauucagcugucccggaagacauucgacacugaguaucagaaaacgaagaauaacgacugggauuacguagugaccacagacaucagugagaugggagcuaauuucagggcggaucgcguuaucgacccucguagaugccucaaacccgugauucugaaggaugguccagaacgggucauccuugccggcccgaugccugugacuguugcaagcgcugcccagaggcgcgggcgaauuggaagaaaccaaaauaaagagggcgaccaguacguguauaugggucagccccuaaacaaugaugaagaccacgcacauuggaccgaggccaagaugcuguuggauaacauaaauacaccagaggggaucauucccgcuuuauuugaaccugagcgggaaaagucggccgcgaucgacggcgaguacaggcugcgcggagaagcaagaaaaaccuucgucgagcucaugaggcggggcgaucugccaguguggcuuucuuauaagguagccuccgagggguuucaguacagcgaccgucgcuggugcuucgauggagaacgaaacaaucaagugcuggaggaaaacauggacguugagaucuggacuaaagaaggugagagaaagaaacucaggccccggugguuggacgcucgcacguauucagauccucuggcccuaagagaguuuaaggaguucgcugcaggcaggcggagugucucuggggaccugauucucgagauaggaaaacuuccgcagcaccugaccuuacgagcccagaaugcuuuggauaaccuggugaugcuccacaauuccgaacagggcgguaaggccuacagacaugcaauggaggaacugccagacacaaucgagacucuuaugcugcucgcguugauugccgugcugaccgggggcgucacauuauuuuuccuaagcggaaagggccuggggaaaaccucaaucggacuccuuuguguuacugcuaguagcgcccuguuguggauggcauccguggagccccacuggauugcugccucuaucauacuggaauuuuuccucaugguacugcuuaucccugagcccgaucgccaaaggacaccacaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggccugcuagcgccuggacccuguacgccgucgcaaccacaguaaucacucccaugaugcgucauacgauagaaaacaccacagcuaauauuuccuugacugccaucgcgaaccaggcugccauucugaugggccucgacaaggguuggccaaucucaaaaauggauauaggggugccucugcuugcauuaggcugcuacucucagguuaauccgcugacccucacagccgcuguguugaugcuggucgcacacuaugccaucauuggacccggccuacaggcgaaggcuaccagagaggcccaaaagaggacugcagccgggaucaugaaaaacccaacgguggacggaauugucgcuaucgaucuggacccugugguuuacgacgccaaguucgaaaaacagcucggccagauaaugcuucugauuuuguguacaagucagauccugcucaugcgcaccacuugggcacugugcgagucgaucaccuuagcuacagguccccuuacuacccugugggaagggagcccaggaaaguuuuggaauacaacgauugccguguccauggcgaacaucuuccggggcucuuaucucgccggugcaggccuagcuuucucacugaugaaaagccuagggggaggccgaagagggaccggagcccaaggcgagacucugggugagaaguggaagaggcagcucaaucagcuuuccaagagugaauuuaacacauacaagcgcucugggauaauggagguagaucggagcgaagcaaaagagggacugaagagaggcgaaaccacuaaacaugcugugucacgugguacagccaaguugaggugguucgucgagcggaaucugguuaagccugagggcaaagugauugaccucggguguggacgcggcgggugguccuauuacugcgccggauuaaagaaagucaccgaagugaagggcuauacgaaaggugggcccggacacgaggaaccgaucccaauggcgaccuacggcuggaaccugguaaaacuuuacaguggcaaagauguguuuuucaugccucccgagaagugugacacacugcuaugcgauauuggggaaagcucuccaaaucccacuaucgaggagggacgaacccucagaguucugaagaugguggaaccuugguugagggguaaccaguuuuguauaaaaauccugaauccguauaugcccuccgucguggagacacucgaacaaaugcagcggaagcauggcgggaugcuuguccgcaacccacugucaagaaauagcacucacgagauguacugggugucgugcggaaccggcaacauuguuucugcuguaaacaugacaaguaggauguuacugaaucgauucaccauggcacaccggaaaccuacuuaugagcgugacguggauuugggugccgggacgagacaugucgcuguggaacccgagguugccaaccucgacaucauuggacagcgcaucgaaaauauuaagaacgagcacaaauccacauggcauuacgaugaagacaauccuuauaagaccugggcauaccacggcagcuaugaggugaagccaucaggcuccgccucuagcauggucaacggggugguaaggcugcuaacuaaacccugggaugugaucccuaugguuacccaaauagcuaugacagacacgaccccauuuggacagcagcgggucuucaaggagaaaguggacacuagaacaccccgcgcgaagagggguaccacucagauuauggaagugacagccaaauggcuuuggggcuuucugagucgaaauaagaagccgcggaucuguaccagagaggaguucacaaggaaaguccgcuccaacgcagcuaucggggccguuuuuguggaugagaaucaauggaacagcgcaaaggaagccguagaggacgagcguuucugggaucucgugcaccgggaaagagagcugcauaaacagggaaagugcgcuacuugcgucuacaauaugaugggcaaaagggaaaagaaguugggugaguuugggaaagccaagggaucucgcgcgauuugguacauguggcugggcgcacgauuccucgaguucgaggcccuuggcuuuaugaacgaggaccacugguucucacgggaaaauagucuguccgggguggagggagaagguuuacauaaacugggcuauauauugagagauaucagcaagauuccugggggaaacauguacgcugacgauaccgccggcugggacacgaggaucaccgaggaugaccuccagaaugaggcaaaaauuacagauaucauggaaccagagcacgcucugcuagccacuucuauauuuaaacuuaccuaucagaacaaaguugugcgcguccaaagacccgcuaagaacgguacagugauggacguaaucucgcggagggaucagcgugggucaggacagguuggcacuuacggccugaauaccuucacgaacauggaagugcagcucauucgacaaauggagagcgaagggaucuuucugccuuccgaguuggagacaccaaauuuagccgaacgcguccuggacuggcucgagaagcauggagcagaaagacuuaaacggauggcgauuaguggugacgauuguguggugaagcccaucgacgauagguucgccaccgcucugacugcccuaaacgacaugggcaaaguccgcaaggauauaccgcagugggagccuucuaaaggguggaaugacuggcagcagguucccuuuugcagccaccacuuccaucaacugauuaugaaggauggaagagaaaucgugguaccaugucggaaccaggacgagcucgugggcagggcacgagucucccagggugcuggguggucauugcgugagacagccugccugggaaagaguuaugcacaaauguggcagcuuauguacuuucacagacgcgaucugcggcucgccgcgaaugcuaucuguucugccgugccuguugacugggugcccaccagcaggacuaccugguccauucaugcacaccaccaguggaugacaacggaagauauguuaucagucuggaacagaguguggauagaggaaaauccauggauggaggacaaaacccauguaagcucuugggaagagguucccuaucugggcaagcgcgaggaccaguggugcggcuccuugaucgggcugacugcccgggcuacaugggccaccaacauucaaguggcaaucaaucaggucaggcgacucauuggaaacgaaaauuaccuugauuacaugacaaguaugaaaagauucaagaacgagagcgacccugaaggugcucugugguga

SEQ ID NO: 13401 - RNA, 9879 nt, Artificial Sequence
  derived and/or modified CDS sequence (opt3) from DENV-1__FJ547068__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuuggcugcgucaguggaacugccaaacaguuuagaggaacucggggacggacuggccaugggcauaaugaugcuuaagcuguugacugaguuccagccccaccagcucuggaccacacugcuaucccugacuuuuaucaaaaccacgcuuucucucgauuacgcauggaagacaaccgcuauggcccugagcauugucuccuuguucccgcuguguuuaucaacuacaagccagaaaaccacuuggcucccugugcugcuuggcaguuuugggugcaagccacugacaauguucuugaucaccgaaaauaagauuuggggaaggaaaucuuggccccucaacgaggguaucauggccauaggcaucguuuccauucugcuaagcucgcugcuuaagaaugacgugccucucgcugggccccugaucgcaggaggcauguugauugccuguuaugucaucucagguucuagugcggauuuaucccuggagaaagcugccgaaguaagcugggagcaagaagcagagcauucugggacgagccacaacauacucguggaaguucaggacgauggaacuaugaagauuaaagacgaggagcgagaugacacccugacaauccuucugaaggccaccuugcuagcuguguccggcgucuacccaaugucaaucccugcaacacuguuugugugguauuucuggcagaaaaagaagcagcgcaguggcguacucugggauacucccagcccaccggaaguggagcgggccguccuggacgaugggauuuacagaauacuucaaaggggauuacugggucguucucagguuggcguggggguguuccaggacggagucuuucauaccauguggcacgugacgcgcggcgcgguucucauguaucaggguaaacgguuggaaccuuccugggcuucaguaaagaaagaccugaucaguuacgggggaggcuggagauuccaaggcagcuggaauacaggggaggaggugcaggucauugccguggaacccggaaagaacccaaaaaauguucagacuacccccgguacauuuaagaccccugagggcgaagugggggcaaucgcccucgauuucaagccaggaacuuccggcucucccauugucaacagggaggguaaaaucguggggcuguacggaaauggcguagucaccacaucgggcacguaugugagcgcuauagcccaagcaaaggcuucacaggaagggccucuuccggagaucgaggacgaaguuuuuaaaaagcgaaaccugacuauuauggauuugcacccaggauccgguaaaacccggcgcuaccuacccgccaucgugagagaggcgauuaagaggaagcugcggacacucaucuuagccccuacccgagucguggcaagugaaauggcugaggcccugaaaggcaugccaauaagauaucagacuacagcuguuaagucugaacauaccgggcgcgagauuguggaccuuaugugccacgcaacguucacuaugaggcugcucagccccguccgugugccuaauuacaacaugaucaucauggaugaggcccauuuuacagacccggccuccauugcugcgcggggauauaucucaaccagaguaggcaugggugaagcagccgcuauauucaugaccgccacucccccagggucuguggaggcauuuccucagagcaaugccguuauucaagaugaagagagggacauccccgaacgcaguuggaacuccggauacgauuggauuacagacuucccaggcaaaaccgucugguuugugccuagcaucaagucuggcaaugauauagcuaacuguuugcgaaaaaacgggaagagagugauucagcugucacggaagacauucgacacugaguaucagaaaacgaagaauaacgacugggauuacgucguaaccacagacaucuccgagaugggagcgaauuucagggccgaucgcgugaucgacccccguagaugccucaaaccaguuauucugaaggaugguccggaacgggugauccuugcaggcccuaugcccgucacuguggcuagugccgcacagaggcgcgggcgaauuggaagaaaccaaaauaaagagggcgaccaguacguuuauaugggucagccacuaaacaaugaugaagaccacgcccauuggaccgaggcuaagaugcuguuggauaacauaaauacacccgaggggaucauuccugccuuauuugaaccagagcgggaaaagagcgcggcaaucgacggcgaguacaggcugcgcggagaagccagaaaaaccuucguggagcucaugaggcggggcgaucugcccgucuggcuuucguauaagguggcuucugagggguuucaguacuccgaccgucgcuggugcuucgauggagaacgaaacaaucaaguacuggaggaaaacauggacguggagaucuggacuaaagaaggugagagaaagaaacucaggccucggugguuggacgcccgcacguauagcgauccgcuggcucuaagagaguuuaaggaauucgcagccggcaggcggucaguuaguggggaccugauucucgagauaggaaaacuuccacagcaccugaccuuacgagcucagaaugccuuggauaaccuggucaugcuccacaauucugaacagggcgguaaggcauacagacaugcgauggaggaacugcccgacacaaucgagacucuuaugcugcucgccuugauugcugugcugaccgggggcgugacauuauuuuuccuauccggaaagggccuggggaaaaccagcaucggacuccuuugugucacugccucaagugcacuguuguggauggcuagcguugagccucacuggauugccgcauccaucauacuggaauuuuuccucauggugcugcuuauccccgagccagaucgccaaaggacaccucaggacaaccagcucgccuauguagugauuggucuguuguuuaugauccugacggucgcugcgaacgaaaugggcuuacuagagaccacuaagaaagaucuggggauuggacauguggccgcagagaaucaccaacacgcuacaaugcucgacguugaucuucggcccgccucugccuggacccuguacgcaguggcuaccacagucaucacuccaaugaugcgucauacgauagaaaacaccacagccaauauuagcuugacugcgaucgcuaaccaggccgcaauucugaugggccucgacaaggguuggccuaucuccaaaauggauauagggguaccgcugcuugccuuaggcugcuacucacaggugaauccccugacccucacagcugcaguuuugaugcugguggcccacuaugcgaucauuggaccaggccuacaggcuaaggccaccagagaggcacaaaagaggacugccgcugggaucaugaaaaacccuacggucgacggaauuguggccaucgaucuggaccccgucguguacgacgcaaaguucgaaaaacagcucggccagauaaugcuucugauuuuguguacaucucagauccugcucaugcgcaccacuugggcucugugcgagaguaucaccuuagccacagguccacuuacuacccugugggaagggucgccuggaaaguuuuggaauacaacgauugcgguuagcauggccaacaucuuccggggcuccuaucucgcaggugcuggccuagccuucucucugaugaaaucauuggggggaggccgaagagggaccggagcacaaggcgagacucugggugagaaguggaagaggcagcucaaucagcuuagcaaauccgaauuuaacacauacaagcgcagugggauaauggagguggaucggucugaagcuaaagagggacugaagagaggcgaaaccacuaaacaugccguaagccgugguacagccaaguugaggugguucguggagcggaaucuggucaagcccgagggcaaaguuauugaccucggguguggacgcggcggguggucauauuacugcgcgggauuaaagaaagugaccgaagucaagggcuauacgaaaggugggccgggacacgaggaaccaaucccuauggcuaccuacggcuggaaccuggugaagcuucauuccggcaaagauguauuuuucaugcccccagagaagugugacacacugcuaugcgauauuggggaaaguagccccaauccuacuaucgaggagggacgaacccucagagugcugaagaugguugaaccgugguugagggguaaccaguuuuguauaaaaauccugaaucccuacaugccaucuguggucgagacacucgaacaaaugcagcggaagcacggcgggaugcuugugcgcaacccucuguccagaaauucaacucacgagauguauugggucagcugcggaaccggcaacauugugucggcaguuaacaugacaucuaggauguuacugaaucgauucaccauggcccaucggaaacccacuuacgagcgugacguagauuugggugcugggacgagacacguggccgucgaaccugagguggcaaaccucgacaucauuggacagcgcaucgaaaauauuaagaacgagcauaaaaguacauggcacuaugaugaagacaauccauacaagaccugggccuaucacggcuccuacgagguuaagcccagcggcucagcuuccucuauggugaacggggucgugaggcugcuaacuaaaccuugggauguaaucccaauggugacccaaauagcgaugacagacacgacccccuuuggacagcagcggguuuucaaggagaaagucgacacuagaacaccgcgcgccaagagggguaccacucagauuauggaagugacagcaaaauggcuuuggggcuuucugagccgaaauaagaagccucggaucuguaccagagaggaauucacaaggaaagugcgcaguaacgcugccaucggggcagucuuuguugaugagaaucaauggaacuccgccaaggaagcuguggaggacgagcguuucugggaucucguacaucgggaaagagagcugcacaaacagggaaagugcgccacuugcguguauaauaugaugggcaaaagggaaaagaaguugggugaguuugggaaagcgaagggaagccgcgcaauuugguacauguggcugggcgcccgauuccucgaauucgaggcucuuggcuuuaugaacgaggaccauugguucucucgggaaaauucacugaguggggucgagggagaagguuuacacaaacugggcuacauauugagagauaucuccaagauuccagggggaaacauguaugccgacgauaccgcaggcugggacacgaggaucaccgaggaugaccuccagaaugaggcuaaaauuacagauaucauggaacccgagcaugcccugcuagcuacuagcauauuuaagcuuaccuaccagaacaaagugguucgcgugcaaagaccugccaagaacgguacagucauggacgugaucucucggagggaucagcgugggucgggacagguaggcacuuauggccugaauaccuucacgaacauggaaguucagcucauucgacaaauggagucagaagggaucuuucugccaagcgaguuggagacacccaauuuagcagaacgcgugcuggacuggcucgagaagcacggagcggaaagacuuaaacggauggccauuuccggugacgauugugucgugaagccgaucgacgauagguucgcuaccgcccugacugcacuaaacgacaugggcaaagugcgcaaggauauaccucagugggagcccaguaaaggguggaaugacuggcagcaggucccauuuugcucucaccauuuccaccaacugauuaugaaggauggaagagaaaucguugugccuugucggaaccaggacgagcucguaggcagggcucgagugagccagggugccgggugguccuugcgugagacagcaugccugggaaagucauacgcccaaauguggcagcuuauguauuuucauagacgcgaucugcggcucgcggcuaaugccaucuguagugcaguccccguggacuggguuccaaccucuaggacuaccuggagcauucacgcccaccaucaguggaugacaacggaagauauguuauccguguggaacagagucuggauagaggaaaaucccuggauggaggacaaaacccacgugucaagcugggaagagguaccuuaccugggcaagcgcgaggaccaguggugcggcucuuugaucgggcugacugcucgggccacaugggcaaccaacauucaaguugcuaucaaucaggugaggcgacucauuggaaacgaaaauuaucuugauuacaugacuuccaugaaaagauucaagaacgagagugacccagaaggugcccugugguga

SEQ ID NO: 13402 - RNA, 9879 nt, Artificial Sequence
  derived and/or modified CDS sequence (opt3) from DENV-1__FJ562104__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacacaaaguucgaaaaacagcucggccagauaaugcuucugauuuuguguaccucucagauccugcucaugcgcacuaccugggcccugugcgagaguaucacauuagcaacugguccacuuaccacacugugggaagggucgccuggaaaguuuuggaauacgaccauugcugugagcauggccaacaucuuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacauauacaagcgcagugggauuauggagguagaucggucugaagccaaagagggacugaagagaggcgaaaccacuaaacaugcagugagccgugguacagcuaaguugaggugguucgucgagcggaaucugguuaagcccgagggcaaagugaucgaccucggguguggacgcggcggguggucauauuacugcgccggauuaaagaaagucaccgaagugaagggcuauacgaaaggugggccgggacacgaggaaccaauuccuauggccaccuacggcuggaaccugguaaagcuucauuccggcaaagauguguuuuucaugcccccagagaagugugacacacugcuaugcgauaucggggaaaguagccccaauccuacuauagaggagggacgaacccucagaguucugaagaugguggaaccgugguugagggguaaccaguuuuguaucaaaauucugaaucccuacaugccaucugucguggagacacucgaacaaaugcagcggaaguauggcgggaugcuuguccgcaacccucuguccagaaauucaacucacgagauguacugggugagcugcggaaccggcaacaucguuucggcgguaaacaugacaucuaggauguuacugaaucgauucaccauggcucaccggaaacccacuuaugagcgugacguggauuugggugcagggacgagacaugucgccguggaaccugagguugcuaaccucgacauuaucggacagcgcauugaaaauaucaagaacgagcacaaaaguacauggcauuacgaugaagacaauccauauaagaccugggccuaccacggcuccuaugaggugaagcccagcggcucagcauccucuauggucaacggggugguaaggcugcuaacuaaaccuugggaugugauaccaaugguuacccaaauugccaugacagacacgacccccuuuggacagcagcgggucuucaaggagaaaguggacacuagaacaccgcgcgcuaagagggguaccacucagaucauggaagugacagcgaaauggcuuuggggcuuucugagccgaaauaagaagccucggaucuguaccagagaggaauucacaaggaaaguccgcaguaacgccgcaauuggggcuguuuuuguggaugagaaucaauggaacuccgccaaggaagcaguagaggacgagcguuucugggaucucgugcaccgggaaagagagcugcauaaacagggaaagugcgccacuugcgucuacaauaugaugggcaaaagggaaaagaaguugggugaguuugggaaagcuaagggaagccgcgccauaugguacauguggcugggcgcgcgauuccucgaauucgaggcacuuggcuuuaugaacgaggaccacugguucucucgggaaaauucacugagugggguggagggagaagguuuacauaaacugggcuauaucuugagagauauuuccaagaucccagggggaaacauguacgccgacgauaccgcuggcugggacacgaggauuaccgaggaugaccuccagaaugaggccaaaaucacagauauaauggaacccgagcacgcacugcuagcuacuagcaucuuuaagcuuaccuaucagaacaaaguugugcgcguccaaagaccugccaagaacgguacagugauggacguaauuucucggagggaucagcgugggucgggacagguuggcacuuacggccugaauaccuucacgaacauggaagugcagcucauccgacaaauggagucagaagggauuuuucugccaagcgaguuggagacacccaauuuagcugaacgcguccuggacuggcucgagaagcauggagccgaaagacuuaaacggauggcaaucuccggugacgauuguguggugaagccgauagacgauagguucgcgaccgcccugacugcucuaaacgacaugggcaaaguccgcaaggauauuccucagugggagcccaguaaaggguggaaugacuggcagcagguuccauuuugcucucaccacuuccaucaacugaucaugaaggauggaagagaaaucgugguaccuugucggaaccaggacgagcucgugggcagggcccgagucagccagggugcagggugguccuugcgugagacagcuugccugggaaagucauaugcccaaauguggcagcuuauguacuuucacagacgcgaucugcggcucgcagccaaugcgauuuguagugcugugcccguugacugggugccaaccucuaggacuaccuggagcauacaugcccaccaccaguggaugacaacggaagauauguuauccgucuggaacagaguguggaucgaggaaaaucccuggauggaggacaaaacccauguaucaagcugggaagagguuccuuaucugggcaagcgcgaggaccaguggugcggcucuuugauugggcugacugcacgggccacaugggcuaccaacauccaaguggccauuaaucaggucaggcgacucaucggaaacgaaaauuaccuugauuacaugacuuccaugaaaagauucaagaacgagagugacccagaaggugcacugugguga

SEQ ID NO: 13403 - RNA, 9879 nt, Artificial Sequence
  derived and/or modified CDS sequence (opt3) from DENV-1__GQ199857__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuaucuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauaauggccaucggcauuguuuccauccugcuaagcucgcugcuuaagaaugacgugccucucgccgggccccugauugcuggaggcauguugaucgcauguuaugucauaucagguucuagugccgauuuaucccuggagaaagcggcugaaguaagcugggagcaagaagccgagcauucugggacgagccacaacauucucguggaaguucaggacgauggaacuaugaagaucaaagacgaggagcgagaugacacccugacaauccuucugaaggcaaccuugcuagccguguccggcgucuacccaaugucaauuccugcuacacuguuugugugguauuucuggcagaaaaagaagcagcgcaguggcguacucugggauacucccagcccaccggaaguggagcgggcaguccuggacgaugggauauacagaauccuucaaaggggauuacugggucguucucagguuggcguggggguguuccaggacggagucuuucauaccauguggcacgugacgcgcggcgccguucucauguaucaggguaaacgguuggaaccuuccugggcgucaguaaagaaagaccugauuaguuacgggggaggcuggagauuccaaggcagcuggaauacaggggaggaggugcaggucaucgcuguggaacccggaaagaacccaaaaaauguucagacuacccccgguacauuuaagaccccugagggcgaagugggggccauugcacucgauuucaagccaggaacuuccggcucucccaucgucaacagggaggguaaaauaguggggcuguacggaaauggcguagucaccacaucgggcacguaugugagcgccaucgcucaagccaaggcaucacaggaagggccucuuccggagauugaggacgaaguuuuuaaaaagcgaaaccugacuaucauggauuugcacccaggauccgguaaaacccggcgcuaccuacccgcuauugugagagaggccaucaagaggaagcugcggacacucauauuagcgccuacccgagucguggccagugaaauggcagaggcucugaaaggcaugccaauuagauaucagacuacagccguuaagucugaacauaccgggcgcgagaucguggaccuuaugugccacgcuacguucacuaugaggcugcucagccccguccgugugccuaauuacaacaugaucauuauggaugaggcacauuuuacagacccggccuccaucgccgcucggggauauauaucaaccagaguaggcaugggugaagcggcagccauuuucaugaccgcuacucccccagggucuguggaggccuuuccucagagcaaugcaguuauccaagaugaagagagggacauucccgaacgcaguuggaacuccggauacgauuggaucacagacuucccaggcaaaaccgucugguuugugccuagcauaaagucuggcaaugauauugccaacuguuugcgaaaaaacgggaagagagugauccagcugucacggaagacauucgacacugaguaucagaaaacgaagaauaacgacugggauuacgucguaaccacagacaucuccgagaugggagcuaauuucagggcggaucgcgugauugacccccguagaugccucaaaccaguuauccugaaggaugguccggaacgggugauucuugccggcccuaugcccgucacuguggcaagugcugcccagaggcgcgggcgaauaggaagaaaccaaaauaaagagggcgaccaguacguuuauaugggucagccacuaaacaaugaugaagaccacgcacauuggaccgaggccaagaugcuguuggauaacaucaauacacccgaggggauuaucccugcuuuauuugaaccagagcgggaaaagagcgccgcgaucgacggcgaguacaggcugcgcggagaagcaagaaaaaccuucguggagcucaugaggcggggcgaucugcccgucuggcuuucguauaagguggccucugagggguuucaguacuccgaccgucgcuggugcuucgauggagaacgaaacaaucaaguacuggaggaaaacauggacguggagauuuggacuaaagaaggugagagaaagaaacucaggccucggugguuggacgcucgcacguauagcgauccgcuggcccuaagagaguuuaaggaauucgcugcaggcaggcggucaguuaguggggaccugauacucgagaucggaaaacuuccacagcaccugaccuuacgagcccagaaugcuuuggauaaccuggucaugcuccacaauucugaacagggcgguaaggccuacagacaugcaauggaggaacugcccgacacaauugagacucuuaugcugcucgcguugaucgccgugcugaccgggggcgugacauuauuuuuccuauccggaaagggccuggggaaaaccagcauuggacuccuuugugucacugcuucaagugcccuguuguggauggcaagcguugagccucacuggaucgcugccuccauaauccuggaauuuuuccucauggugcugcuuauucccgagccagaucgccaaaggacaccucaggacaaccagcucgcauauguagugaucggucuguuguuuaugauucugacggucgccgcuaacgaaaugggcuuacuagagaccacuaagaaagaucuggggaucggacauguggcggccgagaaucaccaacacgcaacaaugcucgacguugaucuucggcccgcuucugccuggacccuguacgccguggcaaccacagucauaacuccaaugaugcgucauacgauugaaaacaccacagcuaauaucagcuugacugccauugcgaaccaggcugccauccugaugggccucgacaaggguuggccuauauccaaaauggauaucgggguaccgcugcuugcauuaggcugcuacucacaggugaauccccugacccucacagccgcuguuuugaugcugguggcacacuaugccauuaucggaccaggccuacaggcgaaggcuaccagagaggcccaaaagaggacugcagccgggauuaugaaaaacccuacggucgacggaaucguggcuauagaucuggaccccgucguguacgacacaaaguucgaaaaacagcucggccagauuaugcuucugaucuuguguaccucucagauccugcucaugcgcacuaccugggcccugugcgagaguauuacauuagcaacugguccacuuaccacacugugggaagggucgccuggaaaguuuuggaauacgaccaucgcuguuagcauggccaacauauuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacauuuacaagcgcagugggaucauggagguggaucggucugaagccaaagagggacugaagagaggcgaaaccacuaaacaugcaguaagccgugguacagcuaaguugaggugguucguggagcggaaucuggucaagcccgagggcaaaguuauugaccucggguguggacgcggcggguggucauauuacugcgccggauuaaagaaagugaccgaagucaagggcuauacgaaaggugggccgggacacgaggaaccaaucccuauggccaccuacggcuggaaccuggugaagcuucauuccggcaaagauguauuuuucaugcccccagagaagugugacacacugcuaugcgauauaggggaaaguagccccaauccuacuaucgaggagggacgaacccucagagugcugaagaugguugaaccgugguugagggguaaccaguuuuguauuaaaauccugaaucccuacaugccaucuguggucgagacacucgaacaaaugcagcggaaguauggcgggaugcuugugcgcaacccucuguccagaaauucaacucacgagauguacugggucagcugcggaaccggcaacauugugucggcgguuaacaugacaucuaggauguuacugaaucgauucaccauggcucaccggaaacccacuuaugagcgugacguagauuugggugcagggacgagacauguggccgucgaaccugagguggcuaaccucgacaucauuggacagcgcaucgaaaauauaaagaacgagcacaaaaguacauggcauuacgaugaagacaauccauauaagaccugggccuaccacggcuccuaugagguuaagcccagcggcucagcauccucuauggugaacggggucgugaggcugcuaacuaaaccuugggauguaauuccaauggugacccaaaucgccaugacagacacgacccccuuuggacagcagcggguuuucaaggagaaagucgacacuagaacaccgcgcgcuaagagggguaccacucagaucauggaagugacagcgaaauggcuuuggggcuuucugagccgaaauaagaagccucggauuuguaccagagaggaauucacaaggaaagugcgcaguaacgccgcaauaggggcugucuuuaucgaugagaaucaauggaacuccgccaaggaagcaguugaggacgagcguuucugggaucucgugcaccgggaaagagagcugcauaaacagggaaagugcgccacuugcguauacaauaugaugggcaaaagggaaaagaaguugggugaguuugggaaagcuaagggaagccgcgccauuugguacauguggcugggcgcgcgauuccucgaauucgaggcacuuggcuuuaugaacgaggaccacugguucucucgggaaaauucacugagugggguggagggagaagguuuacauaaacugggcuauaucuugagagauauuuccaagaucccagggggaaacauguacgccgacgauaccgcuggcugggacacgaggauaaccgaggaugaccuccagaaugaggccaaaaucacagauauuauggaacccgagcacgcacugcuagcuacuagcaucuuuaagcuuaccuaucagaacaaagucgugcgcguucaaagaccugccaagaacgguacagugauggacgucauuucucggagggaucagcgugggucgggacaggugggcacuuacggccugaauaccuucacgaacauggaaguacagcucauccgacaaauggagucagaagggauauuucugccaagcgaguuggagacacccaauuuagcugaacgcguucuggacuggcucgagaagcauggagccgaaagacuuaaacggauggcaauuuccggugacgauuguguggucaagccgaucgacgauagguucgcgaccgcccugacugcucuaaacgacaugggcaaagugcgcaaggauaucccucagugggagcccaguaaaggguggaaugacuggcagcaggugccauuuugcucucaccacuuccaucaacugauuaugaaggauggaagagaaauagucguuccuugucggaaccaggacgagcucgugggcagggcccgaguaagccagggugcagggugguccuugcgugagacagcuugccugggaaagucauaugcccaaauguggcagcuuauguacuuucacagacgcgaucugcggcucgcagccaaugcgaucuguagugcugugcccgucgacugggugccaaccucuaggacuaccuggagcauucaugcccaccaccaguggaugacaacggaagauauguuauccguuuggaacagaguguggaucgaggaaaaucccuggauggaggacaaaacccaugucucaagcugggaagaggugccuuaucugggcaagcgcgaggaccaguggugcggcucuuugauugggcugacugcacgggccacaugggcuaccaacauccaaguagccauaaaucagguuaggcgacucaucggaaacgaaaauuaccuugauuacaugacuuccaugaaaagauucaagaacgagagugacccagaaggugcacugugguga

SEQ ID NO: 13404 - RNA, 9879 nt, Artificial Sequence
  derived and/or modified CDS sequence (opt3) from DENV-1__GQ199858__SS-prME
agcgugaccaugcugcucaugcuucugccaacagcauuggcuuuccacuuaacuacgcgaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuaucuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauaauggccaucggcauuguuuccauccugcuaagcucgcugcuuaagaaugacgugccucucgccgggccccugauugcuggaggcauguugaucgcauguuaugucauaucagguucuagugccgauuuaucccuggagaaagcggcugaaguaagcugggagcaagaagccgagcauucugggacgagccacaacauucucguggaaguucaggacgauggaacuaugaagaucaaagacgaggagcgagaugacacccugacaauccuucugaaggcaaccuugcuagccguguccggcgucuacccaaugucaauuccugcuacacuguuugugugguauuucuggcagaaaaagaagcagcgcaguggcguacucugggauacucccagcccaccggaaguggagcgggcaguccuggacgaugggauauacagaauccuucaaaggggauuacugggucguucucagguuggcguggggguguuccaggacggagucuuucauaccauguggcacgugacgcgcggcgccguucucauguaucaggguaaacgguuggaaccuuccugggcgucaguaaagaaagaccugauuaguuacgggggaggcuggagauuccaaggcagcuggaauacaggggaggaggugcaggucaucgcuguggaacccggaaagaaccccaaaaauguucagacuacccccgguacauuuaagaccccugagggcgaagugggggccauugcacucgauuucaagccaggaacuuccggcucucccaucgucaacagggaggguaaaauaguggggcuguacggaaauggcguagucaccacaucgggcacguaugugagcgccaucgcucaagccaaggcaucacaggaagggccucuuccggagauugaggacgaaguuuuuaaaaagcgaaaccugacuaucauggauuugcacccaggauccgguaaaacccggcgcuaccuacccgcuauugugagagaggccaucaagaggaagcugcggacacucauauuagcgccuacccgagucguggccagugaaauggcagaggcucugaaaggcaugccaauuagauaucagacuacagccguuaagucugaacauaccgggcgcgagaucguggaccuuaugugccacgcuacguucacuaugaggcugcucagccccguccgugugccuaauuacaacaugaucauuauggaugaggcacauuuuacagacccggccuccaucgccgcucggggauauauaucaaccagaguaggcaugggugaagcggcagccauuuucaugaccgcuacucccccagggucuguggaggccuuuccucagagcaaugcaguuauccaagaugaagagagggacauucccgaacgcaguuggaacuccggauacgauuggaucacagacuucccaggcaaaaccgucugguuugugccuagcauaaagucuggcaaugauauugccaacuguuugcggaaaaacgggaagagagugauccagcugucaagaaagacauucgacacugaguaucagaaaacgaagaauaacgacugggauuacgucguaaccacagacaucuccgagaugggagcuaauuucagggcggaucgcgugauugacccccguagaugccucaaaccaguuauccugaaggaugguccggaacgggugauucuugccggcccuaugcccgucacuguggcaagugcugcccagaggcgcgggcgaauaggaagaaaccaaaauaaagagggcgaccaguacguuuauaugggucagccacuaaacaaugaugaagaccacgcacauuggaccgaggccaagaugcuguuggauaacaucaauacacccgaggggauuaucccugcuuuauuugaaccagagcgggaaaagagcgccgcgaucgacggcgaguacaggcugcgcggagaagcaagaaaaaccuucguggagcucaugaggcggggcgaucugcccgucuggcuuucguauaagguggccucugagggguuucaguacuccgaccgucgcuggugcuucgauggagaacgaaacaaucaaguacuggaggaaaacauggacguggagauuuggacuaaagaaggugagagaaagaaacucaggccucggugguuggacgcucgcacguauagcgauccgcuggcccuaagagaguuuaaggaguucgcugcaggcaggcggucaguuaguggggaccugauacucgagaucggaaaacuuccacagcaccugaccuuacgagcccagaaugcuuuggauaaccuggucaugcuccacaauucugaacagggcgguaaggccuacagacaugcaauggaggaacugcccgacacaauugagacucuuaugcugcucgcguugaucgccgugcugaccgggggcgugacauuauuuuuccuauccggaaagggccuggggaaaaccagcauuggacuccuuugugucacugcuucaagugcccuguuguggauggcaagcguugagccucacuggaucgcugccuccauaauccuggaauuuuuccucauggugcugcuuauucccgagccagaucgccaaaggacaccucaggacaaccagcucgcauauguagugaucggucuguuguuuaugauucugacggucgccgcuaacgaaaugggcuuacuagagaccacuaagaaagaucuggggaucggacauguggcggccgagaaucaccaacacgcaacaaugcucgacguugaucuucggcccgcuucugccuggacccuguacgccguggcaaccacagucauaacuccaaugaugcgucauacgauugaaaacaccacagcuaauaucagcuugacugccauugcgaaccaggcugccauccugaugggccucgacaaggguuggccuauauccaaaauggauaucgggguaccgcugcuugcauuaggcugcuacucacaggugaauccccugacccucacagccgcuguuuugaugcugguggcacacuaugccauuaucggaccaggccuacaggcgaaggcuaccagagaggcccaaaagaggacugcagccgggauuaugaaaaacccuacggucgacggaaucguggcuauagaucuggaccccgucguguacgacacaaaguucgaaaaacagcucggccagauuaugcuucugaucuuguguaccucucagauccugcucaugcgcacuaccugggcccugugcgagaguauuacauuagcaacugguccacuuaccacacugugggaagggucgccuggaaaguuuuggaauacgaccaucgcuguuagcauggccaacauauuccggggcuccuaucucgcgggugccggccuagcauucucucugaugaaaucacuagggggaggccgaagagggacuggagcucaaggcgagacacugggugagaaguggaagaggcagcucaaucagcuuagcaaauccgaauuuaacauuuacaagcgcagugggaucauggagguggaucggucugaagccaaagagggacugaagagaggcgaaaccacuaaacaugcaguaagccgugguacagcuaaguugaggugguucguggagcggaaucuggucaagcccgagggcaaaguuauugaccucggguguggacgcggcggguggucauauuacugcgccggauuaaagaaagugaccgaagucaagggcuauacgaaaggugggcugggacacgaggaaccgaucccaauggccaccuacggcuggaaccuugugaagcugcauuccggcaaagauguauuuuucaugccucccgagaagugugacacacuacucugcgauauaggggaaaguagcccaaaucccacuaucgaggagggacgaacccugagaguguugaagaugguugaaccuuggcugagggguaaccaguuuuguauuaaaauccucaauccguacaugcccucuguggucgagacacuugaacaaaugcagcggaaguauggcgggaugcuggugcgcaacccauuauccagaaauucaacucacgagauguacugggucagcugcggaaccggcaacauugugucggcgguuaacaugacaucuaggaugcuguugaaucgauucaccauggcucaccggaaaccuacuuaugagcgugacguagaucucggugcagggacgagacauguggccgucgaacccgagguggcuaaccuggacaucauuggacagcgcaucgaaaauauaaagaacgagcacaaaaguacauggcauuacgaugaagacaauccuuauaagaccugggccuaccacggcuccuaugagguuaagccaagcggcucagcauccucuauggugaacggggucgugaggcuacuuacuaaacccugggauguaauuccuauggugacccaaaucgccaugacagacacgaccccauuuggacagcagcggguuuucaaggagaaagucgacacuagaacaccccgcgcuaagagggguaccacucagaucauggaagugacagcgaaauggcuguggggcuuucucagccgaaauaagaagccgcggauuuguaccagagaggaguucacaaggaaagugcgcaguaacgccgcaauaggggcugucuuuguugaugagaaucaauggaacuccgccaaggaagcaguggaggacgagcguuucugggaucugguacaccgggaaagagaguugcauaaacagggaaagugcgccacuugcguguacaauaugaugggcaaaagggaaaagaagcugggugaguuugggaaagcuaagggaagccgcgccaucugguacauguggcucggcgcgcgauuccuugaguucgaggcacugggcuuuaugaacgaggaccacugguucucucgggaaaauucauuaaguggggucgagggagaaggucugcauaaauugggcuauauucucagagauaucuccaagauuccugggggaaacauguacgccgacgauaccgcuggcugggacacgaggaucaccgaggaugaccugcagaaugaggccaaaauaacagauaucauggaaccagagcacgcacuacuugcuacuagcauuuuuaagcugaccuaucagaacaaagugguucgcgugcaaagacccgccaagaacgguacagucauggacgugaucucucggagggaucagcgugggucgggacagguaggcacuuacggccucaauaccuucacgaacauggaaguucagcugauucgacaaauggagucagaagggaucuuuuugccuagcgaguuagagacaccaaaucuggcugaacgcgugcucgacuggcuugagaagcauggagccgaaagacugaaacggauggcaauauccggugacgauugugucgugaagcccauugacgauagguucgcgaccgcccuaacugcucugaacgacaugggcaaagugcgcaaggauaucccgcagugggagccuaguaaaggguggaaugacuggcagcagguccccuuuugcucucaccacuuccaucaacucaucaugaaggauggaagagaaauuguugugccaugucggaaccaggacgaguugguaggcagggcccgagugagccagggugcaggguggucccugcgugagacagcuugccuuggaaagucauaugcccaaauguggcagcugauguacuuucacagacgcgaucuccgguuagcagccaaugcgauauguagugcugucccuguggacuggguucccaccucuaggacuaccuggagcauccaugcccaccaccaguggaugacaacggaagauaugcuguccguguggaacagagucuggauugaggaaaauccauggauggaggacaaaacccaugugucaagcugggaagagguacccuauuugggcaagcgcgaggaccaguggugcggcucucugaucgggcucacugcacgggccacaugggcuaccaacauucaaguugccaucaaucaggugaggcgacuuauaggaaacgaaaauuaccuggauuacaugacuuccaugaaaagauucaagaacgagagugacccugaaggugcacuaugguga

SEQ ID NO: 13405 - RNA, 9879 nt, Artificial Sequence
  derived and/or modified CDS sequence (opt3) from DENV-1__GQ199859__SS-prME
agcgugaccaugcugcucaugcuucugcccacagccuuggcuuuccacuuaacuacgagaggcggggagccucauaugaucgucuccaagcacgaaaggggaaaaucucugcuauuuaagaccucaacagguguuaacaugugcacucucauugcaauggaccugggcgagcuuugugaagauaccaugacauacaaaugcccacggauaaccgaggccgaaccggacgauguggacuguuggugcaaugcgacugauacauggguaaccuaugggacguguagucagacuggagagcaucgccgagacaagcguagcguggcucuggccccccacgucggcuugggucucgagaccagaacagaaacuuggauguccucugagggggcauggaaacaaauccagaggguggaaaccugggcccugcggcauccuggauucacaguuauugcucuguuucucgcacacgccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccagggagaggcuacauuggucgaagagcaagaugccaacuucguuugccgccgaacucucguggacagaggcugggguaauggguguggacuguuuggcaaaggcagcuuacugaccugcgcaaaguucaagugcguaacaaaacucgaggggaagauagugcaguacgaaaaccuuaaauauuccgucauugugaccguucauacuggagaucagcaccagguggguaaugagacgacagaacauggcaccaucgcuacuauuaccccccaagccccuacaucagagauccagcugaccgacuacggggcguugacucuagacuguaguccaaggacaggacuggauuuuaacgaaaugguccuccugacgaugaaggagaaaagcuggcuugugcacaagcagugguuccuggacuugccgcuccccuggaccucuggcgccuccacuucacaggagacauggaaucggcaagaucuguuaguaaccuuuaaaacagcacacgcuaagaagcaggaaguugugguccuggguagccaggagggggccaugcauacugcucuaaccggcgccacggaaauccaaaccaguggaacaacuaccauuuucgcaggccaccucaaaugccgucugaagauggacaaacuuacauugaaggggacuucuuaugugauguguaccggauccuuuaaacuggagaaggaagucgccgagacgcagcaugguacagugcucguucaggugaaguacgagggcaccgaugcuccuugcaaaauaccauucagcacucaggacgaaaaggggguaacacaaaacggacgccugaucaccgcgaaucccauugucacugauaaagagaagccugugaacaucgaaaccgagccacccuucggcgagucguauauaguugugggugcaggggaaaaagcccuuaagcugucuugguuuaagaaaggcuccucaauuggaaagauguucgaggcuacagccagaggcgcaaggcggauggccaucuugggggacacggcuugggauuuuggaaguaucgguggcgucuucaccagcguggggaaacucguacaccagguguuuggaacugccuacggcguucuguucuccggugucucuuggacaaugaagauugggaucggcauuuuacugaccuggcuaggacucaauagccgaucaacaagucuguccaugacuuguauagcagugggcauggugacccuuuacuugggggucaugguucaggcggacagcggaugcgugaucaacuggaaaggccgcgaacugaagugugguucugggauuuuugugacgaacgagguacauacauggaccgaacaguauaaguuccaagcugauucaccgaaaagacucagugccgcaaucggaaaggccugggaggagggcgucugcgguaucaggagcgcuacucggcuggaaaauauuauguggaaacagauauccaacgaguuaaaucacauccugcuugaaaacgacaugaaguuuaccgugguugugggcgacgccaaugggauuuuggcacagggaaaaaagaugauccgcccucagcccauggagcacaaauacucuuggaagucguggggcaaggcuaaaauuaucggggccgauauacaaaacacaacuuucaucauugacggaccagauaccccugaaugucccgacgaucagagagcguggaauaucugggaggucgaggacuauggcuuugguauuuucacaacgaacaucuggcucaagcugagggauagcuacacccagaugugcgaccaucgucuaauguccgccgcuauaaaagauucaaaggcagugcacgccgacaugggguauuggauugaaagugagaaaaaugaaacuuggaagcuggcucgggccucuuuuaucgagguuaagacauguaccuggccaaaaagccauacucucugguccaacggagugcuggaaucagagaugauuauccccaagauauacggcgguccuaucagccagcacaauuaucgaccaggcuacuucacacaaaccgcagggccguggcaccuuggaaaauuggagcuggauuucgacuuaugcgaaggcacgacuguagucguggaugagcauugcgggaacagaggacccucucucaggaccacaaccgugacuggcaagauuauccacgaaugguguugccgcuccuguacacugccuccacuucgguuuagaggugaggacgggugcugguacggaauggagauuaggcccgucaaagaaaaggaggaaaaucugguucgcaguauggugagcgcgggcucuggugagguagacuccuucucauugggcauccucugugugaguauaaugauugaagaggucaugcgaagccgguggucgcguaagaugcugaugaccgggacacuagccguguuucugcuccugaucaugggacagcuuacuuggaacgauuugaucagacugugcauuaugguuggcgcuaaugccuccgacaggauggggaugggaaccacguauuuagcacucauggcuacauucaaaaugcgcccuauguuugccgugggcauccuguuccggagacuuaccucuagggagguccugcuacucacuauuggucugagcuugguggcaucaguugaacugccaaacaguuuagaggaacucggggauggacuggccaugggcauaaugaugcuuaagcuguugaccgaguuucagccccaucaacucuggacaacucugcuaucccugaccuucaucaaaacgacacuuucucucgacuacgcuuggaagaccacugcgauggcccugagcauuguguccuuguuuccgcuguguuuaucaacaaccagccagaaaacuacauggcucccuguccugcuuggcaguuucgggugcaagccacugaccauguauuugaucacggaaaacaagauuuggggacgaaaaucuuggcccaucaaugaggguauaauggcaaucggcauuguauccauccuccugagcucgcuacugaagaacgaugugccucuugcugggccccucauugccggaggcaugcugaucgccuguuacguuauaucagguucuagugcugacuuguccuuagagaaagcagccgaagugagcugggagcaggaagcggagcacucugggacuagccauaauauucuggucgaagugcaggaugacggaaccaugcgcaucaaggaugaggagaaagacgauacacucaccauccugcuuaaggcuacacuguuggccguauccggcguguauccaaugucaauuccugcaacucuauuugucugguacuucuggcaaaaaaagaagcagcggaguggcguucugugggacacccccagcccaccggaaguggagagagccgugcucgaugacgggauauauaggauccugcagcguggacuuuuaggucgcucucaggucggcguggggguuuuucaagacggaguauuccacacgauguggcacgugacacggggcgcuguccugauguaccaggguaaaagacucgaaccuuccugggcaucagugaagaaagauuugauuaguuacgggggaggcuggagguuccagggcagcuggaacacuggggaggagguucaggugaucgccgucgaacccggaaagaauccaaaaaacgugcaaaccacacccgguaccuuuaagacuccugagggcgaaguaggggcgauugcucuggacuucaagccaggaaccuccggcucucccaucgucaaucgagaggguaaaauaguggggcucuauggaaacggcguugugacaacgucgggcacuuacgucagcgccaucgcacaggccaaggcuucacaggaagggccucugccggagauugaggaugaaguguuuaaaaagcggaaucuuaccaucauggaccugcauccaggauccgguaaaacacgcagauauuugcccgccauuguuagggaggcaaucaagcggaagcuacgaacccugauacucgcuccuacuagaguggucgccagugaaauggcggaggccuuaaaaggcaugccaauucgcuaccaaacaaccgcagugaagucugaacacacggggagggagaucguagaucugaugugccaugcuacuuucacaaugcgucuucugagccccgugcggguuccuaacuauaauaugaucauuauggacgaggcccacuuuaccgauccggcuuccaucgcagccagaggauacauaucaaccagggucggcaugggugaagccgcugcgauuuucaugacugcaacacccccagggucuguggaggccuuuccucagagcaacgcugugauccaggacgaagagcgcgauauucccgaacgaaguuggaauuccggauaugacuggaucaccgauuucccaggcaaaacagucugguuuguaccuagcauaaagucuggcaacgacauugccaauugucucagaaaaaacgggaagcgggugauccaguugucaaggaagacuuucgacacggaguaccaaaaaaccaagaacaaugauugggacuacguugugacaacugauaucuccgagaugggagcaaacuuucgcgccgaccgugucauugaucccagacggugccugaaaccagugauccucaaggacgguccggaaaggguuauucuggcuggcccuaugcccgugaccgucgcgagugccgcacagcgccgagggagaauaggacggaaucagaacaaagagggcgaucaguauguguacaugggucaaccacuuaauaacgacgaagaucaugcucacuggacagaggccaagaugcuacuggacaauaucaacacccccgaggggauuaucccugcauuguucgaaccagagagggaaaagagcgccgcuaucgauggcgaguaucgcuuaagaggagaagccaggaaaacuuucguagagcugaugcggcguggcgaccuccccguguggcugucguacaagguugcgucugagggguuucaguauuccgaucgccgauggugcuucgacggagaaagaaauaaccagguccuugaggaaaauauggacguggagauuuggacgaaagaaggugagaggaagaaacugcggccucgcuggcucgaugcaagaaccuacagcgacccguuggcccugagggaguuuaaggaauucgcugccggccggcgaucagugaguggggaucuaauacuggagaucggaaaacucccacagcaccuuacacugagagcucaaaacgcauuagacaauuuggucaugcugcauaacucugaacagggcgguaaggccuaucgccacgcuauggaggaacuccccgauacuauugagacccugaugcuucuggcccucaucgcaguuuugacagggggcgugacccuguuuuucuuauccggaaagggccuagggaaaacuagcauuggacugcucuguguaacagcgucaagugcccuucuguggauggcuagcguggagccucauuggaucgccgcauccauaaucuuggaauuuuuccugaugguccuccugauucccgagccagacaggcagcggacgccucaggauaaucaacuugcuuacgugguuaucggucuccuguuuaugauuuugaccguggccgcaaacgaaaugggccuguuagagacuacaaagcgugaccuagggaucggacacgucgccgcugagaaccaccagcaugcgaccaugcuggauguagaccucagacccgccucugcauggacccuuuacgcuguggccacaacuguuauaacgccaaugaugaggcacaccauugaaaauacaacugccaacaucagccugaccgcaauugcuaaucaggccgcgaucuugaugggccuggauaaagguuggccuauauccaagauggacaucggggugccgcuccuggcucuuggcugcuauucacaagucaaccccuuaacacugaccgccgcagugcucauguuggucgcccauuacgcuauuaucggaccaggccugcaggcaaaagccacucgcgaggcgcagaagcggacggcugccgggauuaugaagaauccuacaguggauggaaucguugcaauagaccuagaccccgugguauaugaugccaaauucgaaaagcagcugggccaaauuaugcuccuuauccuguguaccucucagaucuugcugaugcgaacuaccugggcucucugcgagaguauuacacuggccacugguccauuaaccacacuuugggaagggucgccuggaaaauuuuggaacacgaccaucgcagugagcauggcuaauauauucagaggcuccuaccuggccggugcgggccucgccuuuucucuaaugaagucacuggggggaggcaggcgcgggacuggagcacagggcgagacauugggugagaaauggaagcggcagcugaaccaacucagcaagcccgaauucaauaccuauaaaagauccgggauuauggaggucgaccguagugaagcuaaggagggacuuaaaaggggcgaaacuacaaagcacgccguuucucgggguaccgcaaaacugcgcugguucguggagcgaaacuuggucaagccggagggcaaggugaucgaucugggguguggaagaggcggguggagcuacuauugcgcuggacucaaaaagguaacggaagugaaaggcuacaccaagggugggccaggacaugaggaaccuauucccauggccacauacggcuggaauuuaguuaaacugcacucaggcaaggacguguuuuucaugccacccgagaaaugugauacucuucugugcgacaucggggaauccaguccuaacccgaccauagaggagggaaggacacuacggguccucaagaugguggaacccuggcugcgcgguaaucaguuuuguaucaagauuuugaacccauauaugccuagcgucguggagacucuggaacagaugcagagaaaacacggcgggaugcucguuaggaauccccuuucucgaaacuccacccaugagauguacuggguaucaugcggaacaggcaauaucgugagcgccgucaacaugaccucgcggaugcuguuaaaccguuucacuauggcgcacagaaagccuacguaugagcgcgauguggaccugggugcugggacaaggcauguugcaguggaaccagaggucgccaauuuggauauuaucggacaacggauugaaaacaucaaaaaugagcacaagucuaccuggcacuacgacgaagauaaccccuauaaaacuugggcuuaccauggcaguuaugaggugaagccuuccggcagcgccucauccaugguaaauggggugguuagacuccugaccaagccaugggacgucauacccauggugacacagauugcaaugacggacaccacuccguuuggacagcaacgcguguucaaagagaaggucgauacaaggaccccucgagccaaacgggguacuacacagaucauggaaguuaccgcuaaguggcuauggggcuuucuuucuagaaacaaaaagccaaggaucuguacacgcgaggaauucacucguaaggugcggagcaaugcggccauuggggcaguauuuguggacgagaaccaguggaauagugcuaaagaagccgucgaggaugagagauucugggaccuggugcacagggaacgcgagcuccauaagcagggaaaaugcgcaaccugcguuuacaacaugaugggcaagcgagaaaaaaagcugggugaguuugggaaggccaaaggaucccgggcuauaugguacaugugguugggcgccagauuccuggaauuugaggcgcucggcuucaugaaugaggaucacugguucagcagggaaaacucucuuucagggguggagggagaaggucugcauaaguuaggcuauauccugcgcgacauuaguaaaauccccgggggaaauauguacgcagaugacacggccggcugggauaccagaauuacagaggacgauuugcaaaacgaggcuaagaucacugacauaauggaaccugagcacgcccuccuggcaaccuccaucuuuaaacuaacauaucagaauaaggucgugcggguacagaggccagcuaaaaacgguacuguuauggaugugauuagccgucgagaccagcgcgggucuggacaagucggcaccuacggccuuaacacguucacaaauauggaagugcagcugaucagacagauggagucggaagggauuuuucuccccucagagcuggagaccccgaacuuggccgaacggguguuagacuggcuggagaagcacggagcugaaaggcucaagcgcauggccaucagcggugaugacugugucguuaaaccuauagaugacagauucgcaacugcgcuuacagcccugaaugauaugggcaaggugcggaaagacauuccccagugggagccauccaagggguggaacgauuggcaacagguaccuuuuugcagucaucacuuccaucagcuaaucaugaaagacggaagggaaaucgugguccccugucgaaaucaggaugagcuggugggccgugcuagaguuucucaaggugccggguggagccuccgcgagaccgcaugcuugggaaaguccuaugcucagauguggcagcugauguacuuucaccggagggaccuuagacuggccgcaaacgccauuuguucagcggugccagucgauugggugcccacuagucgcaccacauggucuauacacgcucaucaccaauggaugacgaccgaagacaugcucagcguauggaaucggguuuggaucgaggaaaacccuuggauggaggacaagacucauguguccucaugggaagaggucccauauuuaggcaaaagggaggaucaguggugcggcagccugauuggguugacagcccgagcaaccugggccacuaauauccagguggcuauuaaccagguuagacggcugaucggaaaugaaaacuaccucgacuacaugacaucuaugaagagguucaaaaaugaguccgauccggaaggugcccuuugguga

SEQ ID NO: 13406 - RNA, 9879 nt, Artificial Sequence
  derived and/or modified CDS sequence (opt3) from DENV-1__JF937645__SS-prME
agcgugaccaugcugcucaugcuucugccaacagcauuggcuuuccacuuaacuacgcgaggaggggaaccucauaugaucgucuccaagcaggaaaggggaaaaucucugcuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacacucguugaccgaggcugggguaauggguguggacuguuuggcaaaggcagcuuacugacuugcgcuaaguucaagugcgugaccaaacucgaggggaagauuguacaguacgaaaaccuuaaauauuccgugaucgucacagugcacaccggagaucaacaucagguugguaaugagacuacggaacacggcacaauugccaccaucacuccccaggcgccuaccucagagauccagcugacagacuacggggccuugacccuagacuguaguccaagaacuggacuggauuuuaacgaaauggugcuccugacaaugaaggagaaaagcuggcuuguccauaagcaaugguuccuggacuugccgcuccccuggacgucuggcgcauccaccucacaggagacuuggaauaggcaggaucuguuagugacauuuaaaaccgcucacgccaagaagcaagaaguaguugugcuggguagccaggagggggcuaugcacacagcccuaacuggcgcaaccgaaauucagacgaguggaaccacaacuauauucgccggccaucucaaaugccggcugaagauggacaaacuuaccuugaaggggacaucuuaugucauguguacuggauccuuuaaacuggagaaggaaguggcugagacccagcacgguacgguccucgugcaaguuaaguacgagggcacagaugcgccuugcaaaaucccauucagcacccaggacgaaaagggggugacucagaacggacgucugauuacagcaaaucccaucguaaccgauaaagagaagccugucaacauagaaacugagccacccuucggcgagucguauauugugguuggugccggggaaaaagcucuuaagcugucuugguuuaagaaaggcuccucaaucggaaagauguucgaggccaccgcacgcggcgccagaaggauggcuaucuugggggacacagccugggauuuuggaaguauugguggcguguucacgagcgucgggaaacucgugcaucagguauuuggaaccgcauacggcgugcuguucuccgguguuucuuggacuaugaagaucgggauuggcauauuacugacauggcuaggacucaauagccggucaaccagucuguccaugacauguaucgcggucggcauggugacucuuuacuugggggugaugguccaagcugacagcggaugcguuauuaacuggaaaggccgagaacugaagugugguucugggaucuuugugaccaacgaggugcacacguggacagaacaguauaaguuccaggccgauucaccgaaacgccucagugcagccaucggaaaggcuugggaggagggcguaugcgguauuagaagcgccaccaggcuggaaaauauaauguggaaacagaucuccaacgaguuaaaucauauucugcuugaaaacgacaugaaguuuacugucgugguuggcgacgcaaaugggaucuuggcucaaggcaaaaagaugauucggccucagcccauggagcacaaauacucuuggaagucguggggcaaggccaaaaucauaggggcggauauccagaacaccacauucauuaucgacggaccagauacuccugaaugucccgacaaucagcgcgccuggaacauuugggagguggaggauuauggcuuugguaucuucaccacaaauauauggcucaagcugagagacagcuacacgcaaaugugcgaucacaggcuaauguccgcugcaauuaaagacucaaaggccguccaugcugauaugggguauuggaucgaaagugagaaaaacgaaaccuggaagcuggcccgugcaucuuuuauugaggugaagacuuguacauggccaaaaagccacacccucugguccaauggaguucuggaaucagagaugaucauacccaagaucuacggcgguccuauuagccagcauaacuaucggccaggcuacuucacucagacagcggggccguggcaccuuggaaaauuggagcuggacuucgauuuaugcgaaggcaccacggugguagucgacgagcacugcgggaaucgaggacccucucucagaacuaccacagugaccggcaagaucauucaugaaugguguugcagguccuguacucugccuccacuucgcuuucggggugaggaugggugcugguacggaauggagaucagacccgugaaagaaaaggaggaaaaccuggucaggaguaugguuagcgccggcucuggugagguggacuccuucucauugggcauacucugugcuaguauuaugaucgaagagguaaugcgcagccgauggucgcggaagaugcugaugacagggacccuagccguguuucugcuccugaucaugggacaacuuacauggaaugacuugauucgucugugcaucauggucggcgcaaacgcuuccgauagaauggggaugggaacuaccuauuuagcccucauggcaacguucaaaaugaggccuauguuugccgugggccugcuuuuccgccggcugacaucuagagagguucuacuccugaccauugguuugagccugguggcuucagucgaauuaccaaacagucucgaggaacugggggacggacuugcgaugggcauaaugaugcugaaguugcucacugaguuucagccccaccagcuguggaccacacuacugucccuuacuuucaucaaaaccacgcucucucuggauuacgccuggaagacaaccgcaauggcuuugagcauugugucccuguuuccguuaugucucucaacuacaagccagaaaaccacuuggcugccuguucuucugggcaguuucgggugcaagccauugacaauguuucucaucaccgaaaauaagauuuggggaaggaaaucuuggccccugaacgaggguaucauggccauaggcaucguguccauucuacugagcucgcuucucaagaaugacgucccucuggccgggcccuugaucgcuggaggcauguuaauugcauguuauguaaucucagguucuagugccgaucugucccucgagaaagcggcugaagugagcugggagcaagaagccgagcauucugggacgagccacaacauacugguugaagugcaggacgauggaacuaugaagauuaaagacgaggagcgagaugacacccuuacaauccuguugaaggcaacccuacuggccgucuccggcguguacccaaugucaaucccugcuacacucuucguaugguauuuuuggcagaaaaagaagcagcgcaguggcgugcugugggauacucccagcccaccggaagucgagcgggcaguucuugacgaugggauuuacagaauauuacaaaggggacugcucggucguucucaggugggcgugggggucuuccaggacggaguguuccauaccauguggcacguuacgcgcggcgccguauugauguaucaggguaaacggcuggaaccuuccugggcgucagugaagaaagaccucaucaguuacgggggaggcuggagauuucaaggcagcuggaauacaggggaggagguccaggugauugcuguugaacccggaaagaaccccaaaaaugugcagacuacccccgguacauucaagaccccugagggcgaagucggggccaucgcacuggauuuuaagccaggaacuuccggcucucccauugugaacagggaggguaaaaucguagggcuuuacggaaauggcgucgugaccacaucgggcacguauguuagcgccauagcucaagccaaggcaucacaggaagggccucugccggagaucgaggacgaaguguucaaaaagcgaaacuugacuauuauggaucuacacccaggauccgguaaaacccggcgcuaccugcccgcuaucgucagagaggccauuaagaggaagcuccggacauuaauccuggcgccuacccgagugguugccagugaaauggcagaggcucuuaaaggcaugccaauaagauaucagacuacagccgugaagucugaacauaccgggcgcgagauugucgaccugaugugccacgcuacguuuacuaugaggcucuugagccccgugcguguaccuaauuacaacaugaucaucauggaugaggcacauuucacagacccggccuccauugccgcucggggauauaucucaaccagagugggcaugggugaagcggcagccauauuuaugaccgcuacucccccagggucuguugaggccuucccucagagcaaugcagucauucaagaugaagagagggacauccccgaacgcaguuggaacuccggauacgauuggauuacagacuuuccaggcaaaaccgugugguucgugccuagcaucaagucuggcaaugauauagccaacugucugcggaaaaacgggaagagagucauucagcucucaagaaagacauuugacacugaguaucagaaaacgaagaauaacgacugggauuacguagugaccacagacaucuccgagaugggagcuaauuucagggcggaucgcguuaucgacccccguagaugccugaaaccagugauucuuaaggaugguccggaacgggucauccuagccggcccuaugcccgugacuguugcaagugcugcccagaggcgcgggcgaauuggaagaaaccaaaauaaagagggcgaccaguacguguauaugggucagccacugaacaaugaugaagaccacgcacauuggaccgaggccaagauguuguuagauaacauaaauacacccgaggggaucauuccugcucuguucgaaccagagcgggaaaagagcgccgcgaucgacggcgaguacaggcuccgcggagaagcaagaaaaaccuuugucgagcugaugaggcggggcgaucuucccguguggcugucguauaagguagccucugagggguuccaguacuccgaccgucgcuggugcuuugauggagaacgaaacaaucaagugcucgaggaaaacauggacguugagaucuggacuaaagaaggugagagaaagaaauugaggccucgguggcuggacgcucgcacguauagcgauccgcuagcccugagagaguucaaggaauuugcugcaggcaggcggucagucaguggggaccucauucuugagauaggaaaacugccacagcacuuaaccuugcgagcccagaaugcucuggauaaccucgugaugcugcacaauucugaacagggcgguaaggccuacagacaugcaauggaggaacuucccgacacaaucgagacucugaugcucuuggcgcugauugccguguuaaccgggggcgucacacuauucuuucuguccggaaagggccucgggaaaaccagcaucggacuucuguguguuacugcuucaagugccuugcuguggauggcaagcguggagccucacuggauugcugccuccaucauacucgaguucuuucugaugguacuucucauccccgagccagaucgccaaaggacaccucaggacaaccagcuggcauauguggucauugguuugcuguucaugaucuuaacgguggccgcuaacgaaaugggccuacuggagaccacuaagaaagaucucgggauuggacauguugcggccgagaaucaccaacacgcaacaaugcuugacguggaucugcggcccgcuucugccuggaccuuguacgccgucgcaaccacaguaaucacuccaaugaugcgucauacgauagaaaacaccacagcuaauauuagccugacugccaucgcgaaccaggcugccauucucaugggccuggacaaggguuggccuaucuccaaaauggauauaggggugccgcuuuuagcacugggcugcuacucacagguuaauccccucaccuugacagccgcugugcugaugcuagucgcacacuaugccaucauuggaccaggccugcaggcgaaggcuaccagagaggcccaaaagaggacugcagccgggaucaugaaaaacccuacgguggacggaauugucgcuaucgaucucgaccccgugguuuacgacgccaaguuugaaaaacagcuuggccagauaaugcuguugauucuguguacaucucagauccuccugaugcgcaccacuugggcauuaugcgagaguaucacccuugcuacagguccacugacuacccucugggaagggucgccuggaaaguucuggaauacaacgauugccgugagcauggcgaacaucuuucggggcuccuaucuagccggugcaggccuggcuuucucuuugaugaaaucacuagggggaggccgaagagggaccggagcccaaggcgagacucucggugagaaguggaagaggcagcuuaaucagcugagcaaauccgaguucaacacauacaagcgcagugggauaauggagguagaucggucugaagcaaaagagggauugaagagaggcgaaaccacuaaacaugcugugagccgugguacagccaagcugaggugguuugucgagcggaaucucguuaagcccgagggcaaagugauugacuuaggguguggacgcggcggguggucauauuacugcgccggacugaagaaagucaccgaagugaagggcuauacgaaaggugggccgggacacgaggaaccaaucccuauggcgaccuacggcuggaaccuuguaaagcugcauuccggcaaagauguguucuuuaugcccccagagaagugugacacacuacucugcgauauuggggaaaguagccccaauccuacuaucgaggagggacgaacccugagaguuuugaagaugguggaaccguggcugagggguaaccaguucuguauaaaaauccucaaucccuacaugccaucugucguggagacacuugaacaaaugcagcggaagcacggcgggaugcugguccgcaacccuuuauccagaaauucaacucacgagauguauugggugagcugcggaaccggcaacauuguuucggcuguaaacaugacaucuaggaugcuguugaaucgauuuaccauggcacaucggaaacccacuuacgagcgugacguggaucucggugccgggacgagacacgucgcuguggaaccugagguugccaaccuggacaucauuggacagcgcaucgaaaauauuaagaacgagcauaaaaguacauggcacuaugaugaagacaauccauacaagaccugggcauaucacggcuccuacgaggugaagcccagcggcucagccuccucuauggucaacggggugguaaggcuacuuacuaaaccuugggaugugaucccaaugguuacccaaauagcuaugacagacacgacccccuucggacagcagcgggucuuuaaggagaaaguggacacuagaacaccgcgcgcgaagagggguaccacucagauuauggaagugacagccaaauggcuguggggcuuccucagccgaaauaagaagccucggaucuguaccagagaggaauuuacaaggaaaguccgcaguaacgcagcuaucggggccguuuucguggaugagaaucaauggaacuccgcaaaggaagccguagaggacgagcguuuuugggaucuggugcaucgggaaagagaguugcacaaacagggaaagugcgcuacuugcgucuauaauaugaugggcaaaagggaaaagaagcugggugaguucgggaaagccaagggaagccgcgcgauuugguacauguggcucggcgcacgauuucuugaguucgaggcccugggcuucaugaacgaggaccauugguuuucucgggaaaauucauuaagugggguggagggagaaggucugcacaaauugggcuacauacucagagauaucuccaagauuccagggggaaacauguaugcugacgauaccgccggcugggacacgaggaucaccgaggaugaccugcagaaugaggcaaaaauuacagauaucauggaacccgagcaugcucuacuugccacuagcauauucaagcugaccuaccagaacaaaguugugcgcguccaaagaccugcuaagaacgguacagugauggacguaaucucucggagggaucagcgugggucgggacagguuggcacuuauggccucaauaccuuuacgaacauggaagugcagcugauucgacaaauggagucagaagggaucuucuugccaagcgaguuagagacacccaaucuggccgaacgcguccucgacuggcuugagaagcacggagcagaaagacugaaacggauggcgauuuccggugacgauuguguggugaagccgaucgacgauagguuugccaccgcucuaacugcccugaacgacaugggcaaaguccgcaaggauauaccucagugggagcccaguaaaggguggaaugacuggcagcagguuccauucugcucucaccauuuucaccaacucauuaugaaggauggaagagaaaucgugguaccuugucggaaccaggacgaguuggugggcagggcacgagucagccagggugcuggguggucccugcgugagacagccugccuuggaaagucauacgcacaaauguggcagcugauguauuuccauagacgcgaucuccgguuagccgcgaaugcuaucuguagugccgugcccguugacugggugccaaccucuaggacuaccuggagcauucacgcacaccaucaguggaugacaacggaagauaugcuguccgucuggaacagaguguggauagaggaaaaucccuggauggaggacaaaacccacguaucaagcugggaagagguuccuuacuugggcaagcgcgaggaccaguggugcggcucucugaucgggcucacugcccgggcuacaugggccaccaacauucaaguggcaaucaaucaggucaggcgacuuauuggaaacgaaaauuaucuggauuacaugacuuccaugaaaagauuuaagaacgagagugacccagaaggugcucuaugguga

SEQ ID NO: 13407 - RNA, 9879 nt, Artificial Sequence
  derived and/or modified CDS sequence (opt3) from DENV-1__FJ850114__SS-prME
agcgugaccaugcugcucaugcuucugccaacagcauuggcuuuccacuuaacuacgagaggaggggaaccucauaugaucgucuccaagcaggaaaggggaaaaucucuguuguuuaagaccucagccgguguuaacaugugcacacucauugcaauggaccugggagaacuuugugaagauacuaugaccuacaaaugcccacaaauaacagaggcggaaccggacgauguggacuguuggugcaaugcuaccgauacuugggugacauaugggaccuguagccagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccuccccugccauucuuagaaaacugugcaucgaagcuaagauaucuaacacgaccacagacaguagguguccaacucagggagaggccaccuugguggaagaacaggaugcaaauuucgucugccggcgcacauuuguugaccgaggcugggguaacggguguggacucuucggcaaaggcucccuguuaacuugcgcuaaguuuaagugcgugaccaaacuggaggggaagauuguacaguacgaaaaucucaaauauucagugaucgucacagugcacaccggagaucaacaucagguugguaacgagacuacggaacacggcacaauugccaccaucacuccccaggcgccuaccagugagauccagcuuacagacuacggggcccugaccuuggacuguagcccaagaacuggacuagauuucaaugaaauggugcugcucacaaugaaggagaaaucuuggcugguccauaagcaaugguuucuugaccugccguugcccuggacguccggcgcaucaaccagccaggagacuuggaacaggcaggaucuccuggugacauucaaaaccgcucacgccaagaagcaagaaguaguuguguuagguagucaggagggggcuaugcacacagcccugacuggcgcaaccgaaauucagacgucuggaaccacaacuauauuugccggccaucuaaaaugccggcucaagauggacaaacugacccuuaaggggacauccuaugucauguguacuggcagcuucaaauuggagaaggaaguggcugagacccagcacgguacgguccuggugcaaguuaaguacgagggcacagaugcgccuugcaaaaucccauucucgacccaggacgaaaagggggugacucagaauggacgucucauuacagcaaaccccaucguaaccgauaaagagaagccugucaauauagaaacugagccacccuuuggcgagucuuauauugugguuggugccggggaaaaagcucugaaacuuuccugguucaagaaaggcucaaguaucggaaagauguuugaggccaccgcacgcggcgccagaaggauggcuauccugggggacacagccugggauuucggaagcauugguggcguguuuacguccgucgggaaauuggugcaucagguauucggaaccgcauacggcgugcucuuuucugguguuagcuggacuaugaagaucgggauuggcauacuguuaacauggcugggacuaaacucacggaguaccucccucagcaugacauguaucgcggucggcauggugacucuguaccuuggggugaugguccaagcugacucuggaugcguuauuaauuggaaaggccgagaauugaagugugguucagggaucuucgugaccaacgaggugcacacguggacagaacaguauaaguuucaggccgauaguccgaaacgccugagcgcagccaucggaaaggcuugggaggagggcguaugcgguauuagauccgccaccaggcucgaaaacauaauguggaaacagaucucuaaugagcugaaccauauuuuacuggaaaaugacaugaaguucacugucgugguuggcgacgcaaacgggauccuugcucaaggcaagaaaaugauucggccucagcccauggagcacaaauacucguggaaaagcuggggcaaggccaagaucauaggggcggauauccagaauaccacauuuauuaucgacggaccagauacuccugaaugucccgacaaccagcgcgccuggaauauuugggagguggaggauuauggcuucgguaucuuuaccacaaacauaugguugaagcucagagacuccuacacgcaaaugugcgaucacaggcugaugucagcugcaauuaaagacaguaaggccguccaugcugauaugggguauuggaucgaaucugagaaaaaugaaaccuggaagcuagcccgugccagcuucauugaggugaagacuuguacauggccaaaaucccacacccuguggucaaacggaguucucgaaagcgagaugaucauacccaagacuuacggcgguccuaucucucagcauaauuaucggccaggcuacuucacacagaccgcggggccguggcaccugggaaaacuugaguuggacuuugaucugugcgaaggcacgacugugguagucgacgagcacugcgggaaccgaggacccuccuuaagaaccacaaccgugacuggcaagauuauccaugaaugguguugcaggaguuguacacucccuccacugcgcuuccggggugaggaugggugcugguacggaauggagauuagacccgugaaagaaaaggaggaaaaucuugucaggagcaugguuucugccggcuccggugagguggacucauuuagucugggcaucuugugugcuagcauaaugauugaagagguaaugcgcucgcgauggucccggaagaugcucaugaccgggacacuggccguguuccuacugcucaucaugggacaacugacuuggaacgaccuuauccguuugugcauuauggucggcgcaaaugcuucugauagaauggggaugggaaccacguaucuggccuuaauggcaacauuuaaaaugaggccuauguucgccgugggccuccuguuucgccggcuuaccagcagagagguucugcuacucacuaucggucugucauugguggcuagugucgaacugccaaacuccuuagaggaacucggggacggacuggcgaugggcauuaugaugcuuaagcuguugaccgaguuccagccccaccagcucuggacaacucugcuaucucugaccuuuauaaaaacgacacuuagccucgauuacgccuggaagaccacugcaauggcucuguccaucgugucauuguucccgcuguguuuaagcacaaccagucagaaaacuacauggcucccuguucugcuuggcucuuuugggugcaagccacugaccauguucuugauuacggaaaacaagaucuggggaaggaaauccuggccccucaaugaggguauuauggccaucggcauagugagcauccugcuaucgucacugcuuaagaacgacgucccucucgccgggccccugauugcuggaggcauguugaucgcauguuauguaauuucugguaguuccgccgauuuaagccuggagaaagcggcugaagugucuugggagcaagaagccgagcauagcgggacuucccacaauauccucguugaagugcaggacgauggaaccaugaagauaaaagacgaggagcgagaugacacacugaccauucuucugaaggcaacauugcuagccgucucaggcguguacccaaugaguaucccugcuacucuguuuguaugguauuucuggcagaaaaagaagcagcgcagcggcgugcucugggauacccccucuccaccggaagucgagcgggcaguucuggacgaugggaucuacaggauucuucaacgaggauuacugggucguucccaggugggcgugggggucuuccaggacggaguguuucauacgauguggcacguuacacgcggcgccguacucauguaucaggguaaacgguuggaaccuucaugggcgagugugaagaaagaccugauaagcuacgggggaggcuggagauuccaaggcuccuggaacacuggggaggagguccaggugaucgcuguugaacccggaaagaaucccaagaacgugcagaccacacccgguaccuuuaagacuccugagggcgaagucggggccauugcacucgauuucaagccaggaaccucuggcucgcccaucgugaauagggaggguaaaauuguagggcuguacggaaacggcgucgugacaacgagcggcacuuauguuucagccaucgcucaagccaaggcaucccaggaagggccucuuccggagauagaggacgaaguguuuaaaaagcgaaaucugaccaucauggauuugcacccaggaagugguaaaacacggcgcuaccuacccgcuauugucagagaggccaucaagaggaagcugcggacccucauuuuagcgccuacucgagugguugccucugaaauggcagaggcucugaaaggcaugccaaucagauaucagacaaccgccguaaagagcgaacauacggggcgcgagauagucgaccuuaugugccacgcuacuuucacaaugaggcugcucucccccgugcguguaccuaacuacaauaugauuaucauggaugaggcacauuuuaccgacccggccucaaucgccgcucggggauauauuucuaccagagugggcaugggugaagcggcagccaucuucaugacugcuacacccccagggagcguugaggccuuuccucagaguaacgcagucauacaagaugaagagagggacauucccgaacgcuccuggaauagcggauacgauuggaucaccgacuucccaggcaaaacagugugguuugugccuucuauuaagucaggcaacgauaucgccaauuguuugagaaagaacgggaagagagucauacagcugucccggaagacuuucgacacggaguaucagaaaaccaagaacaaugacugggauuacguagugacaacugacauuagugagaugggagcuaacuucagggcggaucgcguuaucgacccccguagaugccucaaaccagugauccugaaggaugguccggaacgggucauucuugccggcccuaugcccgugaccguugcaagcgcugcccagaggcgcgggcgaaucggaagaaaucaaaacaaagagggcgaccaguacguguauaugggucagccacuaaauaacgaugaagaccacgcacauuggacagaggccaagaugcuguuggauaauauuaacacccccgaggggauaaucccugcuuuauuugaaccagagcgggaaaagucggccgcgauugacggcgaguacaggcugcgcggagaagcaagaaaaacuuucgucgagcucaugaggcggggcgaucugcccguguggcuuucuuauaagguagccuccgagggguuucaguacagcgaccgucgcuggugcuucgauggagaacgaaauaaccaagugcuggaggaaaauauggacguugagaucuggacgaaagaaggugagagaaagaaacucaggccucggugguuggacgcucgcaccuauucagauccgcuggcccuaagagaguuuaaggaguucgcugcaggcaggcggagugucucuggggaccugauccucgagauuggaaaacuuccacagcaccugacauuacgagcccagaacgcuuuggauaaucuggugaugcuccacaacuccgaacagggcgguaaggccuacagacaugcaauggaggaacugcccgacacuauagagacccuuaugcugcucgcguugaucgccgugcugacagggggcgucaccuuauuuuuccuaagcggaaagggccuggggaaaacuucaauuggacuccuuuguguuacagcuaguagcgcccuguuguggauggcauccguggagccucacuggaucgcugccucuauuauccuggaauuuuuccucaugguacugcuuauacccgagccagaucgccaaaggacgccucaggacaaucagcucgcauauguggucaucggucuguuguuuaugauucugaccguggccgcuaacgaaaugggcuuacuagagacuacaaagaaagaucuggggaucggacauguugcggccgagaaccaccaacacgcaaccaugcucgacguggaucuucggcccgcuagcgccuggacccuguacgccgucgcaacaacuguaauuacgccaaugaugcgucauaccaucgaaaauacaacugcuaacauauccuugaccgccauugcgaaucaggcugccauccugaugggccucgacaaggguuggccuauuucaaaaauggauaucggggugccgcugcuugcauuaggcugcuacucucagguuaacccccugacacucaccgccgcuguguugaugcuggucgcacacuaugccauaaucggaccaggccuacaggcgaaggcuacuagagaggcccaaaagaggacggcagccgggauuaugaaaaauccuacaguggacggaaucgucgcuauugaucuggaccccgugguuuacgacgccaaguucgaaaaacagcucggccagaucaugcuucugauauuguguaccagucagauucugcucaugcgcacuaccugggcacugugcgagucgaucacauuagcuacugguccacuuaccacacugugggaagggagcccuggaaaguuuuggaacacgaccaucgccguguccauggcgaauauuuuccggggcucuuaucucgccggugcaggccuagcuuucucacugaugaaaagccuagggggaggccgaagagggacuggagcccaaggcgagacacugggugagaaguggaagaggcagcucaaccagcuuuccaagagugaauuuaauaccuacaagcgcucugggaucauggagguagaucggagcgaagcaaaagagggacugaagagaggcgaaacuacaaaacaugcugugucacgugguaccgccaaguugaggugguucgucgagcggaaccugguuaagcccgagggcaaagugauagaccucggguguggacgcggcgggugguccuauuacugcgccggauuaaagaaagucacggaagugaagggcuauaccaaaggugggccgggacacgaggaaccaauuccuauggcgacauacggcuggaaucugguaaaacuucauaguggcaaagauguguuuuucaugcccccagagaagugugacacucugcuaugcgauaucggggaaagcucucccaacccuaccauugaggagggacgaacacucagaguucugaagaugguggaaccgugguugagggguaaucaguuuuguaucaaaauacugaaccccuacaugccauccgucguggagauccucgaacaaaugcagcggaagcacggcgggaugcuuguccgcaauccucugucaagaaacagcacucacgagauguauugggugucgugcggaaccggcaauauuguuucugcuguaaacaugacaaguaggauguuacugaaccgauucaccauggcacaucggaaacccacuuacgagcgugacguggauuugggugccgggacgagacacgucgcuguggaaccugagguugccaaucucgacaucauuggacagcgcaucgaaaacauuaagaaugagcauaaauccacauggcacuaugaugaagacaacccauacaagaccugggcauaucacggcagcuacgaggugaagcccucaggcuccgccucuagcauggucaauggggugguaaggcugcuaacuaaaccuugggaugugaucccaaugguuacccaaauagcuaugacagacacgacccccuuuggacagcagcgggucuucaaggagaaaguggacacuagaacaccgcgcgcgaagagggguaccacucagauuauggaagugacagccaaauggcuuuggggcuuucugagucgaaacaagaagccucggaucuguaccagagaggaguucacaaggaaaguccgcuccaaugcagcuaucggggccguuuuuguggaugagaaccaauggaauagcgcaaaggaagccguagaggacgagcguuucugggaucucgugcaucgggaaagagagcugcacaaacagggaaagugcgcuacuugcgucuauaacaugaugggcaaaagggaaaagaaguugggugaguuugggaaagccaagggaucucgcgcgauuugguacauguggcugggcgcacgauuccucgaguucgaggcccuuggcuuuaugaaugaggaccauugguucucacgggaaaacagucuguccgggguggagggagaagguuuacacaaacugggcuacauauugagagauaucagcaagauuccagggggaaauauguaugcugacgauaccgccggcugggacacgaggaucaccgaggaugaccuccagaacgaggcaaaaauuacagauaucauggaacccgagcaugcucugcuagccacuucuauauuuaaacuuaccuaccagaauaaaguugugcgcguccaaagaccugcuaagaacgguacagugauggacguaaucucgcggagggaucagcgugggucaggacagguuggcacuuauggccugaacaccuucacgaauauggaagugcagcucauucgacaaauggagagcgaagggaucuuucugccauccgaguuggagacacccaacuuagccgaacgcguccuggacuggcucgagaagcacggagcagaaagacuuaaacggauggcgauuaguggugacgauuguguggugaagccgaucgacgauagguucgccaccgcucugacugcccuaaaugacaugggcaaaguccgcaaggauauaccucagugggagcccucuaaaggguggaacgacuggcagcagguuccauuuugcagccaccauuuccaccaacugauuaugaaggauggaagagaaaucgugguaccuugucggaaucaggacgagcucgugggcagggcacgagucucccagggugcuggguggucauugcgugagacagccugccugggaaagaguuacgcacaaauguggcagcuuauguauuuucauagacgcgaucugcggcucgccgcgaacgcuaucuguucugccgugcccguugacugggugccaaccagcaggacuaccugguccauucacgcacaccaucaguggaugacaacggaagauauguuaucagucuggaauagaguguggauagaggaaaaccccuggauggaggacaaaacccacguaagcucuugggaagagguuccuuaccugggcaagcgcgaggaccaguggugcggcuccuugaucgggcugacugcccgggcuacaugggccaccaauauucaaguggcaaucaaccaggucaggcgacucauuggaaaugaaaacuaucuugauuacaugaucaguaugaaaagauucaagaaugagagcgacccagaaggugcucugugguga

SEQ ID NO: 13408 - RNA, 9879 nt, Artificial Sequence
  derived and/or modified CDS sequence (opt3) from DENV-1__JN819402__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcaugaccaacaucuuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacaccuacaagcgcagugggauaauggagguagaucggucugaagccaaagagggacugaagagaggcgaaacuacaaaacaugcagugagccgugguaccgcuaaguugaggugguucgucgagcggaaucugguuaagcccgagggcaaagugauugaccucggguguggacgcggcggguggucauauuacugcgccggauuaaagaaagucacggaagugaagggcuauaccaaaggugggccgggacacgaggaaccaaucccuauggccacauacggcuggaaccugguaaagcuucauuccggcaaagauguguuuuucaugcccccagagaagugugacacucugcuaugcgauauuggggaaaguagccccaauccuaccaucgaggagggacgaacacucagaguucugaagaugguggaaccgugguugagggguaaccaguuuuguauaaaaauccugaaucccuacaugccaucugucguggagacucucgaacaaaugcagcggaagcacggcgggaugcuuguccgcaacccucuguccagaaauucaacccacgagauguauugggugagcugcggaacaggcaacauuguuucggcgguaaacaugaccucuaggauguuacugaaucgauucacuauggcucaucggaaacccacguacgagcgugacguggauuugggugcagggacaagacacgucgccguggaaccugagguugcuaaccucgacaucauuggacagcgcaucgaaaauauuaagaacgagcauaaaaguaccuggcacuaugaugaagacaauccauacaagacuugggccuaucacggcuccuacgaggugaagcccagcggcucagcauccucuauggucaacggggugguaaggcugcuaaccaaaccuugggaugugaucccaaugguuacacaaauagccaugacggacaccacucccuuuggacagcagcgggucuucaaggagaaaguggacacaagaaccccgcgcgcuaagagggguacuacacagauuauggaagugaccgcgaaauggcuuuggggcuuucugagccgaaauaagaagccucggaucuguacaagagaggaauucacuaggaaaguccgcaguaacgccgcaaucggggcuguuuuuguggaugagaaucaauggaacuccgccaaggaagcaguagaggacgagcguuucugggaucucgugcaucgggaaagagagcugcacaaacagggaaagugcgccaccugcgucuauaauaugaugggcaaaagggaaaagaaguugggugaguuugggaaagcuaagggaagccgcgccauuugguacauguggcugggcgcgcgauuccucgaauucgaggcacuuggcuuuaugaacgaggaccauugguucucucgggaaaauucacugagugggguggagggagaagguuuacacaaacugggcuacauauugagagauaucuccaagauuccagggggaaacauguaugccgacgauacggcuggcugggacaccaggaucacagaggaugaccuccagaaugaggccaaaauuacugauaucauggaacccgagcaugcacugcuagcuaccagcauauuuaagcuuacauaccagaacaaaguugugcgcguccaaagaccugccaagaacgguacugugauggacguaaucucucggagggaucagcgugggucgggacagguuggcaccuauggccugaauacguucacaaacauggaagugcagcucauucgacugauggagucagaagggaucuuuuugccaagcgaguuagagacccccaaucuggcugaacgcguccucgacuggcuugagaagcacggagccgaaagacugaaacggauggcaauuuccggugacgauuguguggugaagccgaucgacgauagguucgcgacugcccuaacagcucugaacgacaugggcaaaguccgcaaggauauaccucaaugggagcccaguaaaggguggaaugacuggcagcagguuccauuuugcucucaccauuuccaccagcucauuaugaaggauggaagagaaaucgugguaccuugucggaaccaagacgaguuggugggcagggcccgagucagccagggugcaggguggucccugcgugagaccgcuugccuuggaaagucauacgcccagauguggcaacugauguauuuucauagacgcgaucuccgguuagcagccaaugcgaucuguagugcugugcccguugacugggugccaacuucuaggaccacauggagcauucacgcccaccaucaguggaugacgaccgaagauaugcuguccgucuggaacagaguguggauagaggaaaaucccuggauggaggacaaaacucacguaucaagcugggaagagguuccuuacuugggcaagcgcgaggaccaguggugcggcucucugaucgggcucacagcacgggccaccugggcuacuaacauucagguggccaucaaucaagucaggcgacuuauuggaaacgaaaauuaucuggauuacaugacauccaugaaaagauucaagagugagagcgacccagaaggugcacuaugguga

SEQ ID NO: 13409 - RNA, 9879 nt, Artificial Sequence
  derived and/or modified CDS sequence (opt3) from DENV-1__FJ850113__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggugcugagcauuguuuccuuguucccgcuguguuuaucaacuacaagccagaaaaccacuuggcucccugugcugcuuggcaguuuugggugcaagccacugacaauguucuugaucaccgaaaauaagauuuggggaaggaaaucuuggccccucaacgaggguaucauggcuauaggcaucgucuccauucugcuaagcucgcugcuuaagaaugacguaccucucgccgggccccugaucgccggaggcauguugauugcuuguuaugugaucucagguucuagugcagauuuaucccuggagaaagccgcggaaguuagcugggagcaagaagcugagcauucugggacgagccacaacauacucguggaaguccaggacgauggaacuaugaagauuaaagacgaggagcgagaugacacccugacaauccuucugaaggccaccuugcuagcaguguccggcguauacccaaugucaaucccugccacacuguuugugugguauuucuggcagaaaaagaagcagcgcaguggcguccucugggauacucccagcccaccggaaguugagcgggcugugcuggacgaugggauuuacagaauacuucaaaggggauuacugggucguucucaggugggcgucgggguguuccaggacggaguuuuucauaccauguggcacguaacgcgcggcgcagugcucauguaucaggguaaacgguuggaaccuuccugggccucagucaagaaagaccugaucaguuacgggggaggcuggagauuccaaggcagcuggaauacaggggaggaggugcagguuauugcgguggaacccggaaagaacccaaaaaauguccagacuacccccgguacauuuaagaccccugagggcgaagugggggcuaucgcccucgauuucaagccaggaacuuccggcucucccauuguaaacagggaggguaaaaucgucgggcuguacggaaauggcgugguuaccacaucgggcacguaugugagcgcaauagcccaagcuaaggccucacaggaagggccucuuccggagaucgaggacgaagucuuuaaaaagcgaaaccugacuauuauggauuugcacccaggauccgguaaaacccggcgcuaccuacccgcaaucgugagagaggcuauuaagaggaagcugcggacacucaucuuagccccuacccgaguuguggcgagugaaauggccgaggcacugaaaggcaugccaauaagauaucagacuacagcugucaagucugaacauaccgggcgcgagauuguggaccuuaugugccacgccacguucacuaugaggcugcucagccccguacgugugccuaauuacaacaugaucaucauggaugaggcucauuuuacagacccggcauccauugccgcccggggauauaucucaaccagaguuggcaugggugaagcugcggcaauauucaugaccgccacucccccagggucugucgaggcuuuuccucagagcaaugccgugauucaagaugaagagagggacauccccgaacgcaguuggaacuccggauacgauuggauuacagacuucccaggcaaaaccgugugguuugucccuagcaucaagucuggcaaugauauagcaaacuguuugcgaaaaaacgggaagagaguaauucagcugucacggaagacauucgacacugaguaucagaaaacgaagaauaacgacugggauuacgugguuaccacagacaucuccgagaugggagccaauuucagggcugaucgcgugaucgacccccguagaugccucaaaccagucauucugaaggaugguccggaacgggugauccuugcgggcccuaugcccguuacuguggccagugcagcucagaggcgcgggcgaauuggaagaaaccaaaauaaagagggcgaccaguacgucuauaugggucagccacuaaacaaugaugaagaccacgcccauuggaccgaggcaaagaugcuguuggauaacauaaauacacccgaggggaucauuccugccuuauuugaaccagagcgggaaaagagcgcugccaucgacggcgaguacaggcugcgcggagaagcgagaaaaaccuucguggagcucaugaggcggggcgaucugcccguauggcuuucguauaagguggcaucugagggguuucaguacuccgaccgucgcuggugcuucgauggagaacgaaacaaucaaguucuggaggaaaacauggacgucgagaucuggacuaaagaaggugagagaaagaaacucaggccucggugguuggacgcccgcacguauagcgauccgcuggcucuaagagaguuuaaggaauucgccgcuggcaggcggucagugaguggggaccugauucucgagauaggaaaacuuccacagcaccugaccuuacgagcacagaaugccuuggauaaccuggugaugcuccacaauucugaacagggcgguaaggcuuacagacaugccauggaggaacugcccgacacaaucgagacucuuaugcugcucgcauugauugcgguccugaccgggggcguuacauuauuuuuccuauccggaaagggccuggggaaaaccagcaucggacuccuuugugugacugccucaagugcucuguuguggauggccagcguagagccucacuggauugcagcuuccaucauacuggaauuuuuccucauggugcugcuuauccccgagccagaucgccaaaggacaccucaggacaaccagcucgccuaugucgugauuggucuguuguuuaugauccugacgguugcagccaacgaaaugggcuuacuagagaccacuaagaaagaucuggggauuggacauguggcugcggagaaucaccaacacgccacaaugcucgacgucgaucuucggcccgcaucugcuuggacccuguacgccguagccaccacagugaucacuccaaugaugcgucauacgauagaaaacaccacagcaaauauuagcuugacugcuaucgccaaccaggcggcuauucugaugggccucgacaaggguuggccuaucuccaaaauggauauagggguuccgcugcuugccuuaggcugcuacucacaggugaauccccugacccucacagcagccgucuugaugcugguggcucacuaugcaaucauuggaccaggccuacaggccaaggcgaccagagaggcucaaaagaggacugccgcagggaucaugaaaaacccuacggucgacggaauuguggccaucgaucuggaccccguuguguacgacgcuaaguucgaaaaacagcucggccagauaaugcuucugauuuuguguacaucucagauccugcucaugcgcaccacuugggcccugugcgagaguaucaccuuagcaacagguccacuuacuacccugugggaagggucgccuggaaaguuuuggaauacaacgauugcuguaagcauggccaacaucuuccggggcuccuaucucgcgggugccggccuagcauucucucugaugaaaucauuggggggaggccgaagagggaccggagcucaaggcgagacucugggugagaaguggaagaggcagcucaaucagcuuagcaaauccgaauuuaacacauacaagcgcagugggauaauggagguggaucggucugaagccaaagagggacugaagagaggcgaaaccacuaaacaugcagucagccgugguacagcuaaguugaggugguucguugagcggaaucuggugaagcccgagggcaaagucauugaccucggguguggacgcggcggguggucauauuacugcgccggauuaaagaaagugaccgaaguaaagggcuauacgaaaggugggccgggacacgaggaaccaaucccuauggccaccuacggcuggaaccuggugaagcuucauuccggcaaagauguuuuuuucaugcccccagagaagugugacacacugcuaugcgauauuggggaaaguagccccaauccuacuaucgaggagggacgaacccucagagugcugaagauggucgaaccgugguugagggguaaccaguuuuguauaaaaauccugaaucccuacaugccaucuguggucgagacacucgaacaaaugcagcggaagcacggcgggaugcuugugcgcaacccucuguccagaaauucaacucacgagauguauuggguuagcugcggaaccggcaacauuguaucggcggugaacaugacaucuaggauguuacugaaucgauucaccauggcucaucggaaacccacuuacgagcgugacgucgauuugggugcagggacgagacacguggccguugaaccugagguggcuaaccucgacaucauuggacagcgcaucgaaaauauuaagaacgagcauaaaaguacauggcacuaugaugaagacaauccauacaagaccugggccuaucacggcuccuacgaggucaagcccagcggcucagcauccucuauggugaacgggguagugaggcugcuaacuaaaccuugggauguuaucccaauggucacccaaauagccaugacagacacgacccccuuuggacagcagcggguguucaaggagaaaguggacacuagaacaccgcgcgcuaagagggguaccacucagauuauggaagucacagcgaaauggcuuuggggcuuucugagccgaaauaagaagccucggaucuguaccagagaggaauucacaaggaaaguucgcaguaacgccgcaaucggggcuguguuuguagaugagaaucaauggaacuccgccaaggaagcaguggaggacgagcguuucugggaucucguccaucgggaaagagagcugcacaaacagggaaagugcgccacuugcguguauaauaugaugggcaaaagggaaaagaaguugggugaguuugggaaagcuaagggaagccgcgccauuugguacauguggcugggcgcgcgauuccucgaauucgaggcacuuggcuuuaugaacgaggaccauugguucucucgggaaaauucacugagugggguugagggagaagguuuacacaaacugggcuacauauugagagauaucuccaagauuccagggggaaacauguaugccgacgauaccgcuggcugggacacgaggaucaccgaggaugaccuccagaaugaggccaaaauuacagauaucauggaacccgagcaugcacugcuagcuacuagcauauuuaagcuuaccuaccagaacaaagugguccgcgugcaaagaccugccaagaacgguacaguaauggacguuaucucucggagggaucagcgugggucgggacaggugggcacuuauggccugaauaccuucacgaacauggaaguccagcucauucgacugauggagucagaagggaucuuuuugccaagcgaguuagagacacccaaucuggcugaacgcgugcucgacuggcuugagaagcacggagccgaaagacugaaacggauggcaauuuccggugacgauuguguggucaagccgaucgacgauagguucgcgaccgcccuaacugcucugaacgacaugggcaaaguucgcaaggauauaccucaaugggagcccaguaaaggguggaaugacuggcagcaggugccauuuugcucucaccauuuccaccagcucauuaugaaggauggaagagaaaucguagugccuugucggaaccaagacgaguuggucggcagggcccgagugagccagggugcaggguggucccugcgugagacagcuugccuuggaaagucauacgcccagauguggcaacugauguauuuucauagacgcgaucuccgguuagcagccaaugcgaucuguagugcuguucccguggacugggucccaaccucuaggacuaccuggagcauucacgcccaccaucaguggaugacaacggaagauaugcuguccguguggaacagaguauggauagaggaaaaucccuggauggaggacaaaacccacguuucaagcugggaagaggugccuuacuugggcaagcgcgaggaccaguggugcggcucucugaucgggcucacugcacgggccacaugggcuaccaacauucaggucgccaucaaucaagugaggcgacuuauuggaaacgaaaauuaucuggauuacaugacuuccaugaaaagauucaagagugagagcgacccagaaggugcacuaugguga

SEQ ID NO: 13410 - RNA, 9879 nt, Artificial Sequence
  derived and/or modified CDS sequence (opt3) from DENV-1__JF937635__SS-prME
agcgugaccaugcugcucaugcuuaugcccacagcccuggcuuuccacuugacuacgagaggcggggaaccucauaugaucgucuccaagcacgaaagaggaaaagcauuacuguuuaagaccucuaccgguguuaacaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacagacuggagagcaucgccgagacaagcguaguguggcccuugcaccccacgucggccuggguuuggagaccagaacagaaacuuggaugagcuccgagggggccuggaaacaaauccaaaggguggaaaccugggcucuccggcauccuggauucacaguuauugcacuguuucuggcccacgcuaucggcaccucuauuacgcagaagggcaucauauucauccucuuaaugcuggugacuccaucgauggccaugcgcugcgucgggauuggaaacagagauuuuguggagggucuuucaggcgcgacauggguagacguuguguuggagcacgggagcugugucaccacuauggcaaagaauaaacccacacuggauaucgaacugcucaagaccgaggugacgaacccugccgugcugaggaaacuuugcauugaagcuaagaucaguaauaccacaacugacucccgguguccaacccagggagaggccacacuggucgaagaacaagaugcaaacuucguuugccgccgaacuuuuguggacagaggcugggguaauggguguggauuguucggcaaaggcucucuccugaccugcgcuaaguuuaagugcguaacaaaauuagaggggaagauagugcaguacgaaaaccugaaauauagcgucauugugaccguucauacuggagaucagcaccagguggguaaugagacgacagaacauggcaccaucgccacuauuaccccacaagcgccuacauccgagauccagcucaccgacuacggggcccuuacucuggacuguucaccaaggacaggauuggauuucaacgaaaugguccuacugacgaugaaggagaaaaguuggcucgugcacaagcagugguuucuggaccuuccgcugcccuggaccagcggcgcaucuacuucccaggagacauggaaucggcaagauuugcucguaaccuucaaaacagcucacgccaagaagcaggaaguugugguccuggguucacaggagggggcuaugcauacugccuuaaccggcgcaacggaaauccaaaccagcggaacaacuaccauuuuugccggccaccugaaaugccgucuaaagauggacaaacucacacugaaggggacaaguuaugugauguguaccggaucuuucaaacuugagaaggaagucgcugagacgcagcaugguacaguguugguucaggugaaguacgagggcaccgaugcgccuugcaaaauaccauucuccacucaggacgaaaaggggguaacacaaaacggacgccugaucaccgcaaaucccauugucacugauaaagagaagccugugaacaucgaaaccgagccacccuuuggcgagagcuauauaguugugggugccggggaaaaagcucucaagcugucgugguucaagaaaggaucuuccauuggaaagauguuugaggccacagcaagaggcgccaggcggauggcuauccuuggggacacggccugggauuucggaucaaucgguggcgucuuuaccaguguggggaaacugguacaccagguguucggaacugcauacggcguuuuguuuagcggugucuccuggacaaugaagauugggaucggcauucuccugaccugguuaggacuaaauucucgaagcacaucacuaaguaugacuuguauagcggugggcauggugacccucuaccugggggucaugguucaggcugacuccggaugcgugaucaacuggaaaggccgcgaacuuaagugugguagcgggauuuucgugacgaacgagguacauacauggaccgaacaguauaaguuucaagccgauucuccgaaaagauugucagcagccaucggaaaggcuugggaggagggcgucugcgguaucaggagugccacucggcuggaaaauauuauguggaaacagauaagcaacgagcucaaucacauccuguuagaaaacgacaugaaguucaccgugguugugggcgacgcaaaugggauucuggcucagggcaagaagaugauccgcccucagcccauggagcacaaauacuccuggaagucuuggggcaaggccaaaauuaucggggcggauauacaaaacacaacuuuuaucauugacggaccagauaccccugaaugucccgacgaucagagagccuggaauaucugggaggucgaggacuauggcuucgguauuuuuacaacgaacaucuggcuuaaguugagggauucguacacccagaugugcgaccaucgucucaugagcgcugcaauaaaagauuccaaggccgugcacgcugacaugggguauuggauugaaucagagaaaaaugaaacuuggaagcuggcccgggcaaguuucaucgagguuaagacauguaccuggccaaaaucucauacucuauggagcaacggagugcuggaauccgagaugauuauccccaagauauacggcgguccuaucucacagcacaauuaucgaccaggcuacuucacacaaaccgcggggccguggcaccucggaaaacuggagcuugauuuugacuugugcgaaggcacgacuguagucguggaugagcauugcgggaacagaggacccagccugaggaccacaaccgugacuggcaagauuauccacgaaugguguugccgcucuuguacauuaccuccacuccgguucagaggugaggacgggugcugguacggaauggagauuaggcccgucaaagaaaaggaggaaaaucugguucgcuccauggugagugccggcagcggugagguagacucuuuuucccuuggcauccugugugugucaauaaugauugaagaggucaugcgaagucgguggagccguaagauguugaugaccgggacacucgcuguguuccugcuacugaucaugggacagcucacuuggaacgaucugaucagacuuugcauuaugguuggcgccaaugcaucggacaggauggggaugggaaccacguauuuggcucugauggccacauuuaaaaugcgcccuauguucgcagugggcaucuuauuucggagacucaccuccagggagguccugcuucugacuauuggucuaucucucguggccagcguugaacugccaaacucauuggaggaacugggggauggauuagcuaugggcauaaugaugcucaagcugcuuaccgaguuccagccccaucaacuguggacaacuuugcucagucugaccuuuaucaaaacgacacuaucccuggacuacgcguggaagaccacugccauggcacuuucuauugugagccucuucccgcuguguuuguccacaaccucacagaaaacuacauggcugccugucuuacucggcagcuuugggugcaagccacugaccauguuccuuaucacggaaaacaagauuuggggacgaaaaaguuggcccaucaaugaggguauaauggcuaucggcauuguaucuauccuguuguccagccuccugaagaacgaugugccucuagccgggccccugauugccggaggcaugcuuaucgcuuguuauguuauaucggguucaucugcagaccucagucuggagaaagccgcggaaguguccugggagcaggaagcugagcacagcgggacuucucauaauauuuuggucgaagugcaggaugacggaaccaugcgcaucaaggaugaggagaaagacgauacauuaaccauccugcucaaggccacacugcuugcaguaagcggcguguacccaauguccauuccugccacucuguuugucugguauuucuggcagaagaagaagcagcggucaggcguuuugugggacacccccaguccaccggaaguggagagagcugugcuagaugacgggauauacaggauccugcagcguggacuccugggucgcagccaggucggcguggggguuuuccaagacggaguauuucacacgauguggcacgugacacggggcgcaguccuuauguaucaggguaaaagauuagaaccuucuugggccuccgugaagaaagaucugauuucauacgggggaggcuggagguuccagggcaguuggaacacuggggaggagguucaggugaucgcggucgaacccggaaagaaucccaaaaacgugcaaaccacacccgguaccuuuaagacuagcgagggcgaaguaggggcuauugcccucgacuucaagccuggaaccuccggcucuccaaucgucaaucgagaggguaaaauagugggguuguacggaaacggcguugugacaacgucgggcacuuaugucagcgcaaucgcccaggcuaagaccucacaggaagggcccccuccggagauugaggaugaaguguuuaaaaagcggaaucugacaaucauggaccuccauccaggauccgguaaaacccgcagauaccugcccgccauuguuagggaggcaaucaagcggaaacuucgaacucugauauuggcuccuacaagaguggucgccagugaaauggcggaggcccuaaaaggcaugccaauucgcuaucaaaccacggcagugaagucugaacacacugggagggagaucguagaucugaugugccaugcuacauucaccaugcgucucuuaagccccgugcggguuccuaacuacaauaugaucauuauggacgaggcccacuuuaccgauccggcuuccaucgcagccagaggauauauaucaacuagggucggcaugggugaagccgcugcgauuuucaugacagcaacacccccagggucuguggaggccuuuccucagagcaacgcugugauccaggacgaagaacgcgauauucccgaacgaaguuggaacuccggauacgacuggaucacagauuucccaggcaaaacugucugguuuguaccuagcauaaagucuggcaaugacauugccaauugucugaggaaaaacgggaagcgggugauccagcuuucaaggaagacguucgacaccgaguaucagaaaacuaagaacaaugauugggacuacguugugacuaccgauaucuccgagaugggagcaaacuuccgcgccgaccgugucauugaucccagacggugccugaaaccagugauccucaaggacgguccggaaaggguuauuuuggcuggcccuaugcccgugacagucgcgagugccgcacaacgccgagggagaauaggacggaaucagaacaaagagggcgaucaguacguguauaugggucaaccacugaauaacgacgaagaucaugcucacuggaccgaggccaagaugcuccuggacaauaucaacacucccgaggggauuaucccugcacuuuuugaaccagagagggaaaagagcgccgcuaucgauggcgaguaccgccuaagaggagaagccaggaaaacguucguagagcugaugcggcguggcgacuugcccgugugguuaucguauaagguugcgucugagggguuucaguacuccgaucgccgauggugcuucgacggagaaagaaauaaccagguccuggaggaaaauauggacguggagauuuggaccaaagaaggugagaggaagaaacuccggccucgcuggcuggaugcaagaacauauagcgacccgcuugcccugagggaguuuaaggaguucgcugccggccggcgaucagugaguggggaucucauauuggagaucggaaaacugccacagcaccuaacucugagagcucaaaacgcacucgacaaucuugucaugcugcauaacucugaacagggcgguaaggccuaccgccacgcuauggaggaauuacccgauaccauugagacauugaugcugcucgcccugaucgcaguucuuaccgggggcgugacucuguuuuuccucuccggaaagggcuuggggaaaacaagcauuggacuguuauguguaacggcgucaagugcccuacuguggauggcuagcguggagccucauuggaucgccgcauccauaauccucgaauuuuuccuuaugguccuguugauucccgagccagacaggcagcggaccccucaggauaaucaacuggcuuaugugguuaucggucuccuguuuaugauucuuacuguggccgcaaacgaaaugggccuccuggagacaaccaagcgugacuuggggaucggacacgucgccgcugagaaccaccagcaugcgaccaugcuggauguagacuuaagacccgccucugcauggacacuauacgcuguggccacuacgguuauaaccccaaugaugaggcacacaauugaaaauacuaccgccaacaucagccugacagcaauugcuaaucaggccgcgauccucaugggccuugauaaagguuggccuauauccaagauggacaucggggugccgcuguuggcucugggcugcuacucacaagucaacccccucacccugacugccgcagugcuuauguuagucgcccauuaugcuauuaucggaccaggccugcaggcaaaagccacgcgcgaggcgcagaagcggacagcugccgggauuaugaagaauccuaccguggauggaaucguugcaauagaccucgaccccgugguauacgaugccaaauucgaaaagcaguugggccaaauuaugcugcuaauccuguguacuucucagauccuccuuaugcgaaccacaugggcucugugcgagaguauuacuuuggccaccgguccacugacaacgcucugggaagggucgccuggaaaauuuuggaacaccacuaucgcagugagcauggcuaauauauucagaggcuccuaucuggccggugcgggcuuagccuucucucuuaugaagucacuagggggaggcaggcgcgggacaggagcacagggcgagacccucggugagaaauggaagcggcagcuaaaccaacugagcaagcccgaauuuaauacuuacaaaagauccgggauuauggaggucgaccguagugaagcuaaggagggauugaaaaggggcgaaacaaccaagcacgccguuucucgggguacggcaaaacugcgcugguucguggagcgaaaccucgucaagccggagggcaaggugaucgaucuuggguguggaagaggcggguggagcuauuacugcgcuggacugaaaaagguaaccgaagugaaaggcuauacaaagggugggccaggacaugaggaaccuauucccauggccacuuacggcuggaauuugguuaaacugcacucaggcaaggacguguuuuucaugccacccgagaaaugugauacccucuuaugcgacaucggggaauccaguccuaacccgacaauagaggagggaaggacucugcggguccuuaagaugguggaacccuggcugcgcgguaaucaguuuuguaucaagauucuaaacccauacaugccuagcgucguggagacccucgaacagaugcagagaaaacacggcgggaugcugguuaggaaucccuugucucgaaacuccacacaugagauguauuggguaucaugcggaaccggcaauaucgugagcgccgucaacaugacuucgcggaugcugcucaaccguuucacgauggcgcacagaaagccuacauacgagcgcgauguggaccuuggugcugggaccaggcauguugcaguggaaccagaggucgccaaucuggauauuaucggacaacggauugaaaacaucaaaaaugagcacaagucuacuuggcacuaugacgaagauaaccccuacaaaaccugggcuuaucauggcaguuacgaggugaagccuuccggcagcgccucauccaugguaaauggggugguuagauuacugacaaagccaugggacgucauacccauggugacgcagauugcaaugaccgacacuacaccguuuggacagcaacgcguguucaaagagaaggucgauaccaggacuccucgagccaaacgggguacaacccagaucauggaaguuacagcuaagugguuguggggcuuucucucuagaaacaaaaagccaaggaucuguacucgcgaggaguucacccguaaggugcggagcaaugcggccauuggggcaguauuuguggacgagaaccaguggaauagugcuaaagaagccgucgaggaugagagauucugggaccuggugcacagggaacgcgagcuacauaagcagggaaaaugcgcaacgugcguuuauaacaugaugggcaagcgagagaagaaacuuggugaguuugggaaagccaaaggaucccgggcuauaugguacauguggcugggcgccagauuccucgaguucgaggcgcugggcuuuaugaaugaggaucacugguucagcagggaaaacucuuugucagggguggagggagaaggucugcauaagcucggcuacauccuucgcgacauuaguaaaauccccgggggaaauauguaugcagaugacaccgccggcugggauacaagaauuacugaggacgaucugcaaaacgaggcuaagaucaccgacauaauggaaccugagcacgccuuacuggcaacauccaucuuuaaauugacuuaccagaauaaggucgugcggguacagaggccagcuaaaaacgguaccguuauggaugugauuagccgucgagaccagcgcgggucuggacaagucggcacguauggccucaacacauucaccaauauggaagugcagcugaucagacagauggagucggaagggauuuuucuacccucagagcuugagacuccgaaccuggccgaacgggugcucgacuggcuggagaagcacggagcugaaagguugaagcgcauggccaucagcggugaugacugugucguuaaaccuauagaugacagauucgcaacagcguuaaccgcccugaaugauaugggcaaggugcggaaagacauuccccagugggagccauccaagggguggaacgauuggcaacagguaccuuuuugcagucaucacuuccaucagcucaucaugaaagacggaagggaaaucgugguccccugucgaaaucaggaugagcuugugggccgugcuagaguuucucaaggugccggguggagccugcgcgagacugcaugccuaggaaaguccuacgcucagauguggcagcugauguauuuucaccggagggaccucagauuggccgcaaacgccauuuguucagcggugccagucgauugggugcccaccagucgcacaacguggucuauacacgcucaucaccaauggaugaccacugaagacaugcugagcguauggaaucggguuuggaucgaggaaaacccuuggauggaggacaagacacauguguccucaugggaagaggucccauaccuuggcaaaagggaggaucaguggugcggcagccugauugggcucaccgcccgagcaacuugggccacaaauauccagguggcuauuaaccagguuagacgguuaaucggaaaugaaaacuaucuggacuacaugaccucuaugaagagguucaaaaaugaguccgauccggaaggugccuugugguga

SEQ ID NO: 13411 - RNA, 9879 nt, Artificial Sequence
  derived and/or modified CDS sequence (opt3) from DENV-1__FJ024483__SS-prME
agcgugaccaugcugcucaugcuucugccaacagcauuggcuuuccacuuaacuacgcgaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuacacucagacagcggggccguggcaccugggaaaacuugaguuggacuucgaucugugcgaaggcaccacggugguagucgacgagcacugcgggaaucgaggacccucuuuaagaacuaccacagugaccggcaagaucauucaugaaugguguugcagguccuguacucucccuccacugcgcuuucggggugaggaugggugcugguauggaauggagaucagacccgugaaagaaaaggaggaaaaccuugucaggaguaugguuagcgccggcucuggugagguggacuccuucucacugggcauauugugugcuaguauuaugaucgaagagguaaugcgcagccgauggucgcggaagaugcucaugacagggacccuggccguguuucuacugcucaucaugggacaacugacauggaaugaccuuauucguuugugcaucauggucggcgcaaacgcuuccgauagaauggggaugggaacuaccuaccuggccuuaauggcaacguucaaaaugaggccuauguuugccgugggccuccuguuccgccggcuuacaucuagagagguucugcuacucaccauuggucugagcuugguggcuucagucgaacugccaaacaguuuagaggaacucggggacggacuggcgaugggcauaaugaugcuuaagcuguugacugaguuucagccccaccagcucuggaccacacugcuaucccugacuuucaucaaaaccacgcuuucucucgauuaugccuggaagacaaccgcaauggcucugagcauuguguccuuguuuccgcuguguuuaucaacuacaagccagaaaaccacuuggcucccuguucugcuuggcaguuucgggugcaagccacugacaauguuuuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuacguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguauccaaugucaaucccugcuacacuguucguaugguacuuuuggcagaaaaagaagcagcgcaguggcgugcucugggauacucccagcccaccggaagucgagcgggcaguucuggacgaugggauuuauagaauacuucaaaggggauuacugggucguucucaggugggcgugggggucuuccaggacggaguguuccauaccauguggcacguuacgcgcggcgccguacucauguaccaggguaaacgguuggaaccuuccugggcgucagugaagaaagaccugaucaguuacgggggaggcuggagauuucaaggcagcuggaauacaggggaggagguccaggugauugcuguugaacccggaaagaaccccaagaaugugcagacuacccccgguacauucaagaccccugagggcgaagucggggccaucgcacucgauuuuaagccaggaacuuccggcucucccauugugaacagggaggguaaaaucguagggcuguauggaaauggcgucgugaccacaucgggcacguacguuagcgccauagcucaagccaaggcaucacaggaagggccucuuccggagaucgaggacgaaguguucaaaaagcgaaaccugacuauuauggauuugcacccaggauccgguaaaacccggcgcuaucuacccgcuaucgucagagaggccauuaagaggaagcugcggacacucaucuuagcgccuacccgagugguugccagugaaauggcagaggcucugaaaggcaugccaauaagauaccagacuacagccgugaagucugaacauaccgggcgcgagauugucgaccuuaugugccacgcuacguuuacuaugaggcugcucagccccgugcguguaccuaauuauaacaugaucaucauggaugaggcacauuucacagacccggccuccauugccgcucggggauacaucucaaccagagugggcaugggugaagcggcagccauauuuaugaccgcuacucccccagggucuguugaggccuucccucagagcaaugcagucauucaagaugaagagagggacauccccgaacgcaguuggaacuccggauaugauuggauuacagacuuuccaggcaaaaccgugugguucgugccuagcaucaagucuggcaaugauauagccaacuguuugcggaaaaacgggaagagagucauucagcugucaagaaagacauuugacacugaguaccagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguauguguacaugggucagccacuaaacaaugaugaagaccacgcacauuggaccgaggccaagaugcuguuggauaacauaaauacacccgaggggaucauuccugcuuuauucgaaccagagcgggaaaagagcgccgcgaucgacggcgaguauaggcugcgcggagaagcaagaaaaaccuuugucgagcucaugaggcggggcgaucugcccguguggcuuucguacaagguagccucugagggguuccaguauuccgaccgucgcuggugcuuugauggagaacgaaacaaucaagugcuggaggaaaacauggacguugagaucuggacuaaagaaggugagagaaagaaacucaggccucggugguuggacgcucgcacguacagcgauccgcuggcccuaagagaguucaaggaauuugcugcaggcaggcggucagucaguggggaccugauucucgagauaggaaaacuuccacagcaccugaccuuacgagcccagaaugcuuuggauaaccuggugaugcuccacaauucugaacagggcgguaaggccuauagacaugcaauggaggaacugcccgacacaaucgagacucuuaugcugcucgcguugauugccgugcugaccgggggcgucacauuauucuuucuauccggaaagggccuggggaaaaccagcaucggacuccuuuguguuacugcuucaagugcccuguuguggauggcaagcguggagccucacuggauugcugccuccaucauacuggaguucuuucucaugguacugcuuauccccgagccagaucgccaaaggacaccucaggacaaccagcucgcauacguggucauuggucuguuguucaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuauucacagguuaauccccugacccucacagccgcuguguugaugcuggucgcacacuacgccaucauuggaccaggccuacaggcgaaggcuaccagagaggcccaaaagaggacugcagccgggaucaugaaaaacccuacgguggacggaauugucgcuaucgaucuggaccccgugguuuaugacgccaaguuugaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguucuggaauacaacgauugccgugagcauggcgaacaucuuucggggcuccuaccucgccggugcaggccuagcuuucucucugaugaaaucacuagggggaggccgaagagggaccggagcccaaggcgagacucugggugagaaguggaagaggcagcucaaucagcuuagcaaauccgaguucaacacauauaagcgcagugggauaauggagguagaucggucugaagcaaaagagggacugaagagaggcgaaaccacuaaacaugcugugagccgugguacagccaaguugaggugguuugucgagcggaaucugguuaagcccgagggcaaagugauugaccucggguguggacgcggcggguggucauacuauugcgccggauuaaagaaagucaccgaagugaagggcuacacgaaaggugggccgggacacgaggaaccaaucccuauggcgaccuacggcuggaaccugguaaaacuucauuccggcaaagauguguucuuuaugcccccagagaagugugacacacugcuaugcgauauuggggaaaguagccccaauccuacuaucgaggagggacgaacccucagaguucugaagaugguggaaccgugguugagggguaaccaguucuguauaaaaauccugaaucccuauaugccaucugucguggagacacucgaacaaaugcagcggaagcacggcgggaugcuuguccgcaacccucuguccagaaauucaacucacgagauguacugggugagcugcggaaccggcaacauuguuucggcuguaaacaugacaucuaggauguuacugaaucgauuuaccauggcacaucggaaacccacuuaugagcgugacguggauuugggugccgggacgagacacgucgcuguggaaccugagguugccaaccucgacaucauuggacagcgcaucgaaaauauuaagaacgagcauaaaaguacauggcacuacgaugaagacaauccauauaagaccugggcauaccacggcuccuaugaggugaagcccagcggcucagccuccucuauggucaacggggugguaaggcugcuaacuaaaccuugggaugugaucccaaugguuacccaaauagcuaugacagacacgacccccuucggacagcagcgggucuuuaaggagaaaguggacacuagaacaccgcgcgcgaagagggguaccacucagauuauggaagugacagccaaauggcuuuggggcuuccugagccgaaauaagaagccucggaucuguaccagagaggaauuuacaaggaaaguccgcaguaacgcagcuaucggggccguuuucguggaugagaaucaauggaacuccgcaaaggaagccguagaggacgagcguuuuugggaucucgugcaucgggaaagagagcugcacaaacagggaaagugcgcuacuugcgucuacaauaugaugggcaaaagggaaaagaaguugggugaguucgggaaagccaagggaagccgcgcgauuugguacauguggcugggcgcacgauuucucgaguucgaggcccuuggcuucaugaacgaggaccauugguuuucucgggaaaauucauucagugggguggagggagaaggucugcacaaauuaggcuauauacugagagauaucuccaagauuccagggggaaacauguacgcugacgauaccgccggcugggacacgaggaucaccgaggaugacuugcagaaugaggcaaaaauuacagauaucauggaacccgagcaugcucuccuggccacuagcauauuuaagcuaaccuaucagaacaaaguugugcgcguccaaagaccugcuaagaacgguacagugauggacguaaucucucggagggaucagcgugggucgggacagguuggcacuuacggccuuaauaccuucacgaacauggaagugcagcugauucgacaaauggagucagaagggaucuuucucccaagcgagcuggagacacccaauuuggccgaacgcgucuuagacuggcuggagaagcacggagcagaaagacucaaacggauggcgauuuccggugacgauuguguggugaagccgaucgacgauagguucgccaccgcucuuacugcccugaacgacaugggcaaaguccgcaaggauauaccucagugggagcccaguaaaggguggaaugacuggcagcagguuccauuuugcucucaccauuuccaccaacuaauuaugaaggauggaagagaaaucgugguaccuugucggaaccaggacgagcuggugggcagggcacgagucagccagggugcuggguggucccuccgugagacagccugcuugggaaagucauaugcacaaauguggcagcugauguacuuucauagacgcgaucuucggcuggccgcgaaugcuaucuguagugccgugcccguugacugggugccaaccucuaggacuaccuggagcauucacgcacaccaucaguggaugacaacggaagauaugcucuccgucuggaacagaguguggauagaggaaaaucccuggauggaggacaaaacccacguaucaagcugggaagagguuccuuauuuaggcaagcgcgaggaccaguggugcggcucucugaucggguugacugcccgggcuacaugggccaccaacauucaaguggcaaucaaucaggucaggcgacugauuggaaacgaaaauuaccucgauuacaugacuuccaugaaaagauucaagaacgagagugacccagaaggugcucuuugguga

SEQ ID NO: 13412 - RNA, 9879 nt, Artificial Sequence
  derived and/or modified CDS sequence (opt3) from DENV-1__EU596504__SS-prME
agcgugaccaugcugcucaugcuucugccaacagcauuggcuuuccacuuaacuacgagaggaggggaaccucauaugauagucuccaagcaggaaaggggaaaaucucuguuguuuaagaccucagccgguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguuucgcggucggcauggugacucuguaccuuggggugaugguccaagcugacagcggaugcguuaucaacuggaaaggccgagaauugaagugugguucugggauuuuugugaccaacgaggugcacacguggacagaacaguauaaguuccaggccgauucaccgaaacgccugagugcagccaucggaaaggcuugggaggagggcguaugcgguaucagaagcgccaccaggcucgaaaauauuauguggaaacagauauccaacgagcugaaucauaucuuacuggaaaacgacaugaaguuuacugucgugguuggcgacgcaaaugggauucuugcucaaggcaagaagaugauccggccucagcccauggagcacaaauacucuuggaagucguggggcaaggccaaaauuaucggggcggauauacagaacaccacauucaucauugacggaccagauacuccugaaugucccgacaaucagcgcgccuggaacaucugggagguggaggauuauggcuuugguauuuucaccacaaauaucugguugaagcucagagacagcuacacgcaaaugugcgaucacaggcugauguccgcugcaauaaaagacucaaaggccguccaugcugauaugggguauuggauugaaagugagaaaaacgaaaccuggaagcuagcccgugcaucuuucaucgaggugaagacuuguacauggccaaaaagccacacccugugguccaauggaguucucgaaucagagaugauuauccccaagauauacggcgguccuaucagccagcauaacuaucggccaggcuacuuuacucagacagcggggccguggcaccugggaaaacuugaguuggacuucgaucugugcgaaggcaccacggugguagucgacgagcacugcgggaaucgaggacccucuuuaagaacuaccacagugaccggcaagauuauccaugaaugguguugcagguccuguacucucccuccacugcgcuuucggggugaggaugggugcugguacggaauggagauuagacccgugaaagaaaaggaggaaaaccuugucaggaguaugguuagcgccggcucuggugagguggacuccuucucacugggcaucuugugugcuaguauaaugauugaagagguaaugcgcagccgauggucgcggaagaugcucaugacagggacccuggccguguuucuacugcucaucaugggacaacugacauggaaugaccuuauccguuugugcauuauggucggcgcaaacgcuuccgauagaauggggaugggaacuaccuaucuggccuuaauggcaacguucaaaaugaggccuauguuugccgugggccuccuguuccgccggcuuacaucuagagagguucugcuacucaccaucggucugagcuugguggcuucagucgaacugccaaacaguuuagaggaacucggggacggacuggcgaugggcauuaugaugcuuaagcuguugacugaguuucagccccaccagcucuggaccacacugcuaucccugacuuucauaaaaaccacgcuuucucucgauuacgccuggaagacaaccgcaauggcucugagcaucguguccuuguuuccgcuguguuuaucaacuacaagccagaaaaccacuuggcucccuguucugcuuggcaguuucgggugcaagccacugacaauguuuuugauuaccgaaaauaagaucuggggaaggaaaucuuggccccucaacgaggguauuauggccaucggcauaguguccauccugcuaagcucgcugcuuaagaaugacgucccucucgccgggccccugauugcuggaggcauguugaucgcauguuauguaauuucagguucuagugccgauuuaucccuggagaaagcggcugaagugagcugggagcaagaagccgagcauucugggacgagccacaacauccucguugaagugcaggacgauggaacuaugaagauaaaagacgaggagcgagaugacacccugacaauucuucugaaggcaaccuugcuagccgucuccggcguguacccaaugucaaucccugcuacacuguucguaugguauuucuggcagaaaaagaagcagcgcaguggcgugcucugggauacucccagcccaccggaagucgagcgggcaguucuggacgaugggaucuacaggauucuucaacgaggauuacugggucguucucaggugggcgugggggucuuucaggacggaguguuccauaccauguggcacguuacgcgcggcgccguacucauguaucaggguaaacgguuggaaccuuccugggcgucagugaagaaagaccugauaaguuacgggggaggcuggagauuucaaggcagcuggaauacaggggaggagguccaggugaucgcuguugaacccggaaagaaccccaagaaugugcagacuacccccgguacauucaagaccccugagggcgaagucggggccauugcacucgauuuuaagccaggaacuuccggcucucccaucgugaacagggaggguaaaauuguagggcuguacggaaauggcgucgugaccacaucgggcacguauguuagcgccaucgcucaagccaaggcaucacaggaagggccucuuccggagauagaggacgaaguguucaaaaagcgaaaccugacuaucauggauuugcacccaggauccgguaaaacccggcgcuaccuacccgcuauugucagagaggccaucaagaggaagcugcggacacucauuuuagcgccuacccgagugguugccagugaaauggcagaggcucugaaaggcaugccaaucagauaucagacuacagccgugaagucugaacauaccgggcgcgagauagucgaccuuaugugccacgcuacguuuacuaugaggcugcucagccccgugcguguaccuaauuacaacaugauuaucauggaugaggcacauuucacagacccggccuccaucgccgcucggggauauauuucaaccagagugggcaugggugaagcggcagccaucuuuaugaccgcuacucccccagggucuguugaggccuucccucagagcaaugcagucauacaagaugaagagagggacauucccgaacgcaguuggaacuccggauacgauuggaucacagacuuuccaggcaaaaccgugugguucgugccuagcauuaagucuggcaaugauaucgccaacuguuugagaaagaacgggaagagagucauacagcugucacggaagacauucgacacugaguaucagaaaacgaagaauaacgacugggauuacguagugaccacagacauuuccgagaugggagcuaauuuuagggcggaucgcguuaucgacccccguagaugccucaaaccagugauccugaaggaugguccggaacgggucauucuugccggcccuaugcccgugacuguugcaagugcugcccagaggcgcgggcgaaucggaagaaaccaaaauaaagagggcgaccaguacguguauaugggucagccacuaaacaaugaugaagaccacgcacauuggaccgaggccaagaugcuguuggauaacauuaauacacccgaggggauaaucccugcuuuauucgaaccagagcgggaaaagagcgccgcgauugacggcgaguacaggcugcgcggagaagcaagaaaaaccuuugucgagcucaugaggcggggcgaucugcccguguggcuuucguauaagguagccucugagggguuccaguacuccgaccgucgcuggugcuuugauggagaacgaaacaaucaagugcuggaggaaaacauggacguugagaucuggacuaaagaaggugagagaaagaaacucaggccucggugguuggacgcucgcacguauagcgauccgcuggcccuaagagaguucaaggaauuugcugcaggcaggcggucagucaguggggaccugauccucgagauuggaaaacuuccacagcaccugaccuuacgagcccagaaugcuuuggauaaccuggugaugcuccacaauucugaacagggcgguaaggccuacagacaugcaauggaggaacugcccgacacaauagagacucuuaugcugcucgcguugaucgccgugcugaccgggggcgucacauuauucuuucuauccggaaagggccuggggaaaaccagcauuggacuccuuuguguuacugcuucaagugcccuguuguggauggcaagcguggagccucacuggaucgcugccuccauuauccuggaguucuuucucaugguacugcuuauacccgagccagaucgccaaaggacaccucaggacaaccagcucgcauauguggucaucggucuguuguucaugauucugacgguggccgcuaacgaaaugggcuuacuagagaccacuaagaaagaucuggggaucggacauguugcggccgagaaucaccaacacgcaacaaugcucgacguggaucuucggcccgcuucugccuggacccuguacgccgucgcaaccacaguaauuacuccaaugaugcgucauacgaucgaaaacaccacagcuaauaucagcuugacugccauugcgaaccaggcugccauccugaugggccucgacaaggguuggccuauuuccaaaauggauaucggggugccgcugcuugcauuaggcugcuacucacagguuaauccccugacccucacagccgcuguguugaugcuggucgcacacuaugccauaaucggaccaggccuacaggcgaaggcuaccagagaggcccaaaagaggacugcagccgggauuaugaaaaacccuacgguggacggaaucgucgcuauugaucuggaccccgugguuuacgacgccaaguuugaaaaacagcucggccagaucaugcuucugauauuguguacaucucagauucugcucaugcgcaccacuugggcacugugcgagaguaucaccuuagcuacagguccacuuacuacccugugggaagggucgccuggaaaguucuggaauacaacgaucgccgugagcauggcgaacauuuuccggggcuccuaucucgccggugcaggccuagcuuuuucucugaugaaaucacuagggggaggccgaagagggaccggagcccaaggcgagacucugggugagaaguggaagaggcagcucaaucagcuuagcaaauccgaguucaacacauacaagcgcagugggaucauggagguagaucggucugaagcaaaagagggacugaagagaggcgaaaccacuaaacaugcugugagccgugguacagccaaguugaggugguuugucgagcggaaucugguuaagcccgagggcaaagugauagaccucggguguggacgcggcggguggucauauuacugcgccggauuaaagaaagucaccgaagugaagggcuauacgaaaggugggccgggacacgaggaaccaauuccuauggcgaccuacggcuggaaccugguaaaacuuuacuccggcaaagauguguucuuuaugcccccagagaagugugacacacugcuaugcgauaucggggaaaguagccccaauccuacuauugaggagggacgaacccucagaauccugaagaugguugaaccgugguugagggguaaccaguucuguauaaaaauccugaaucccuauaugccaucuguggucgagacacucgaacaaaugcagcggaagcauggcgggaugcuugugcgcaacccucuguccagaaauucaacucacgagauguacugggucagcugcggaaccggcaacauugugucggcuguuaacaugacaucuaggauguuacugaaucgauuuaccauggcacaccggaaacccacuuaugagcgugacguagauuugggugccgggacgagacauguggcugucgaaccugagguggccaaccucgacaucauuggacagcgcaucgaaaauauuaagaacgagcacaaaaguacauggcauuacgaugaagacaauccauauaagaccugggcauaccacggcuccuaugagguuaagcccagcggcucagccuccucuauggugaacggggucgugaggcugcuaacuaaaccuugggauguaaucccaauggugacccaaauagcuaugacagacacgacccccuucggacagcagcggguuuuuaaggagaaagucgacacuagaacaccgcgcgcgaagagggguaccacucagauuauggaagugacagccaaauggcuuuggggcuuccugagccgaaauaagaagccucggaucuguaccagagaggaauuuacaaggaaagugcgcaguaacgcagcuaucggggccgucuucguugaugagaaucaauggaacuccgcaaaggaagccguggaggacgagcguuuuugggaucucguacaccgggaaagagagcugcauaaacagggaaagugcgcuacuugcguguacaauaugaugggcaaaagggaaaagaaguugggugaguucgggaaagccaagggaagccgcgcgauuugguacauguggcugggcgcacgauuccucgaauuugaggcccuuggcuucaugaacgaggaccacugguuuucucgggaaaauucacugaguggggucgagggagaagguuuacauaaacugggcuauauauugagagauaucuccaagauuccagggggaaacauguacgcugacgauaccgccggcugggacacgaggaucaccgaggaugaccuccagaaugaggcaaaaauuacagauaucauggaacccgagcacgcucugcuagccacuagcauauucaaacuuaccuaucagaacaaagugguucgcgugcaaagaccugcuaagaacgguacagucauggacgugaucucucggagggaucagcgugggucgggacagguaggcacuuacggccugaauaccuuuacgaacauggaaguucagcucauucgacaaauggagucagaagggaucuuccugccaagcgaguuggagacacccaauuuagccgaacgcgugcuggacuggcucgagaagcauggagcagaaagacuuaaacggauggcgauuuccggugacgauugugucgugaagccgaucgacgauagguuugccaccgcucugacugcccuaaacgacaugggcaaagugcgcaaggauauaccucagugggagcccaguaaaggguggaaugacuggcagcaggucccauucugcucucaccacuuucaucaacugauuaugaaggauggaagagaaaucguugugccuugucggaaccaggacgagcucguaggcagggcacgagugagccagggugcugggugguccuugcgugagacagccugccugggaaagucauaugcacaaauguggcagcuuauguacuuccacagacgcgaucugcggcucgccgcgaaugcuaucuguagugccguccccguggacuggguuccaaccucuaggacuaccuggagcauucaugcacaccaccaguggaugacaacggaagauauguuauccguguggaacagagucuggauagaggaaaaucccuggauggaggacaaaacccaugugucaagcugggaagagguaccuuaucugggcaagcgcgaggaccaguggugcggcucuuugaucgggcugacugcccgggcuacaugggccaccaacauucaaguugcaaucaaucaggugaggcgacucauuggaaacgaaaauuaccuugauuacaugacuuccaugaaaagauuuaagaacgagagugacccagaaggugcucugugguga

SEQ ID NO: 13413 - RNA, 9879 nt, Artificial Sequence
  derived and/or modified CDS sequence (opt3) from DENV-1__FJ024481__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauaauggagguagaucggucugaagcaaaagagggacugaagagaggcgaaaccacuaaacaugcugugagccgugguacagccaaguugaggugguucgucgagcggaaucugguuaagcccgagggcaaagugauugaccucggguguggacgcggcggguggucauauuacugcgccggauuaaagaaagucaccgaagugaagggcuauacgaaaggugggccgggacacgaggaaccaaucccuauggcgaccuacggcuggaaccugguaaagcuuuacuccggcaaagauguguuuuucaugcccccagagaagugugacacacugcuaugcgauauuggggaaaguagccccaauccuacuaucgaggagggacgaacccucagaauacugaagaugguugaaccgugguugagggguaaccaguuuuguaucaaaauucugaaucccuauaugccaucuguggucgagacacucgaacaaaugcagcggaagcauggcgggaugcuugugcgcaacccucuguccagaaauucaacucacgagauguacugggucagcugcggaaccggcaacaucgugucggcuguuaacaugacaucuaggauguuacugaaucgauucaccauggcacaccggaaacccacuuaugagcgugacguagauuugggugccgggacgagacauguggcugucgaaccugagguggccaaccucgacauuaucggacagcgcauugaaaauaucaagaacgagcacaaaaguacauggcauuacgaugaagacaauccauauaagaccugggcauaccacggcuccuaugagguuaagcccagcggcucagccuccucuauggugaacggggucgugaggcugcuaacuaaaccuugggauguaauaccaauggugacccaaauugcuaugacagacacgacccccuuuggacagcagcggguuuucaaggagaaagucgacacuagaacaccgcgcgcgaagagggguaccacucagaucauggaagugacagccaaauggcuuuggggcuuucugagccgaaauaagaagccucggaucuguaccagagaggaauucacaaggaaagugcgcaguaacgcagcuauuggggccgucuuuguugaugagaaucaauggaacuccgcaaaggaagccguggaggacgagcguuucugggaucucguacaccgggaaagagagcugcauaaacagggaaagugcgcuacuugcguguacaauaugaugggcaaaagggaaaagaaguugggugaguuugggaaagccaagggaagccgcgcgauaugguacauguggcugggcgcacgauuccucgaauucgaggcccuuggcuuuaugaacgaggaccacugguucucucgggaaaauucacugaguggggucgagggagaagguuuacauaaacugggcuauaucuugagagauauuuccaagaucccagggggaaacauguacgcugacgauaccgccggcugggacacgaggauuaccgaggaugaccuccagaaugaggcaaaaaucacagauauaauggaacccgagcacgcucugcuagccacuagcaucuuuaagcuuaccuaucagaacaaagugguucgcgugcaaagaccugcuaagaacgguacagucauggacgugauuucucggagggaucagcgugggucgggacagguaggcacuuacggccugaauaccuucacgaacauggaaguucagcucauccgacaaauggagucagaagggauuuuucugccaagcgaguuggagacacccaauuuagccgaacgcgugcuggacuggcucgagaagcauggagcagaaagacuuaaacggauggcgaucuccggugacgauugugucgugaagccgauagacgauagguucgccaccgcucugacugcccuaaacgacaugggcaaagugcgcaaggauauuccucagugggagcccaguaaaggguggaaugacuggcagcaggucccauuuugcucucaccacuuccaucaacugaucaugaaggauggaagagaaaucguugugccuugucggaaccaggacgagcucguaggcagggcacgagugagccagggugcugggugguccuugcgugagacagccugccugggaaagucauaugcacaaauguggcagcuuauguacuuucacagacgcgaucugcggcucgccgcgaaugcuauuuguagugccguccccguggacuggguuccaaccucuaggacuaccuggagcauacaugcacaccaccaguggaugacaacggaagauauguuauccguguggaacagagucuggaucgaggaaaaucccuggauggaggacaaaacccaugugucaagcugggaagagguaccuuaucugggcaagcgcgaggaccaguggugcggcucuuugauugggcugacugcccgggcuacaugggccaccaacauccaaguugcaauuaaucaggugaggcgacucaucggaaacgaaaauuaccuugauuacaugacuuccaugaaaagauucaagaacgagagugacccagaaggugcucugugguga

SEQ ID NO: 13414 - RNA, 9879 nt, Artificial Sequence
  derived and/or modified CDS sequence (opt3) from DENV-1__GQ199872__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccgugagcauggcgaacaucuuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauaauggagguagaucggucugaagcaaaagagggacugaagagaggcgaaaccacuaaacaugcugugagccgugguacagccaaguugaggugguucgucgagcggaaucugguuaagcccgagggcaaagugauugaccucggguguggacgcggcggguggucauauuacugcgccggauuaaagaaagucaccgaagugaagggcuauacgaaaggugggccgggacacgaggaaccaaucccuauggcgaccuacggcuggaaccugguaaagcuucauuccggcaaagauguguuuuucaugcccccagagaagugugacacacugcuaugcgauauuggggaaaguagccccaauccuacuaucgaggagggacgaacccucagaguucugaagaugguggaaccgugguugagggguaaccaguuuuguauaaaaauccugaaucccuacaugccaucugucguggagacacucgaacaaaugcagcggaagcacggcgggaugcuuguccgcaacccucuguccagaaauucaacucacgagauguauugggugagcugcggaaccggcaacauuguuucggcuguaaacaugacaucuaggauguuacugaaucgauucaccauggcacaucggaaacccacuuacgagcgugacguggauuugggugccgggacgagacacgucgcuguggaaccugagguugccaaccucgacaucauuggacagcgcaucgaaaauauuaagaacgagcauaaaaguacauggcacuaugaugaagacaauccauacaagaccugggcauaucacggcuccuacgaggugaagcccagcggcucagccuccucuauggucaacggggugguaaggcugcuaacuaaaccuugggaugugaucccaaugguuacccaaauagcuaugacagacacgacccccuuuggacagcagcgggucuucaaggagaaaguggacacuagaacaccgcgcgcgaagagggguaccacucagauuauggaagugacagccaaauggcuuuggggcuuucugagccgaaauaagaagccucggaucuguaccagagaggaauucacaaggaaaguccgcaguaacgcagcuaucggggccguuuuuguggaugagaaucaauggaacuccgcaaaggaagccguagaggacgagcguuucugggaucucgugcaucgggaaagagagcugcacaaacagggaaagugcgcuacuugcgucuauaauaugaugggcaaaagggaaaagaaguugggugaguuugggaaagccaagggaagccgcgcgauuugguacauguggcugggcgcacgauuccucgaauucgaggcccuuggcuuuaugaacgaggaccauugguucucucgggaaaauucacugagugggguggagggagaagguuuacacaaacugggcuacauauugagagauaucuccaagauuccagggggaaacauguaugcugacgauaccgccggcugggacacgaggaucaccgaggaugaccuccagaaugaggcaaaaauuacagauaucauggaacccgagcaugcucugcuagccacuagcauauuuaagcuuaccuaccagaacaaaguugugcgcguccaaagaccugcuaagaacgguacagugauggacguaaucucucggagggaucagcgugggucgggacagguuggcacuuauggccugaauaccuucacgaacauggaagugcagcucauucgacaaauggagucagaagggaucuuucugccaagcgaguuggagacacccaauuuagccgaacgcguccuggacuggcucgagaagcacggagcagaaagacuuaaacggauggcgauuuccggugacgauuguguggugaagccgaucgacgauagguucgccaccgcucugacugcccuaaacgacaugggcaaaguccgcaaggauauaccucagugggagcccaguaaaggguggaaugacuggcagcagguuccauuuugcucucaccauuuccaccaacugauuaugaaggauggaagagaaaucgugguaccuugucggaaccaggacgagcucgugggcagggcacgagucagccagggugcugggugguccuugcgugagacagccugccugggaaagucauacgcacaaauguggcagcuuauguauuuucauagacgcgaucugcggcucgccgcgaaugcuaucuguagugccgugcccguugacugggugccaaccucuaggacuaccuggagcauucacgcacaccaucaguggaugacaacggaagauauguuauccgucuggaacagaguguggauagaggaaaaucccuggauggaggacaaaacccacguaucaagcugggaagagguuccuuaccugggcaagcgcgaggaccaguggugcggcucuuugaucgggcugacugcccgggcuacaugggccaccaacauucaaguggcaaucaaucaggucaggcgacucauuggaaacgaaaauuaucuugaucauaugacuuccaugaaaagauucaagaacgagagugacccagaaggugcucugugguga

SEQ ID NO: 13415 - RNA, 9879 nt, Artificial Sequence
  derived and/or modified CDS sequence (opt3) from DENV-1__FJ410290__SS-prME
agcgugaccaugcugcucaugcuucugcccacagcauuggcuuuccacuuaacuacgagaggaggggagccucauaugaucgucuccaagcaagaaaggggaaaaucucuguuauuuaagaccucagccgguguuaacaugugcacacucauugcaauggaccugggagagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgagaagcgaagcguggcccuggcaccccaugucggauugggucucgaaacucguaccgagacauggauguccucugaaggggccuggaaacagauccagagaguggagacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgacuuuguggaggguuugagcggcgcgacuuggguagauguugugcuggaacacgggaguugugucacaaccauggcaaagaauaaacccacuuuggacaucgagcuccugaagacagaagugaccuccccugccauucuuagaaaacugugcaucgaggcuaagauaucuaacacgaccacagauagcagauguccaacucagggagaagccaccuugguggaggagcaggacgcaaauuucgucugccggcgcacauuuguugaucgaggcugggguaacggguguggacucuucggcaaaggcucccuguuaacuugcgcuaaguuuaagugcgugaccaaacuggaagggaagauuguacaguacgagaaucucaaauauucagugaucgucacagugcacaccggagaccaacaucagguugguaacgaaacuacggagcacggcacaauugccaccaucacuccccaggcgccuaccagugaaauccagcuuacagauuacggggcccugaccuuggacuguagcccaagaacuggacuagacuucaaugagauggugcugcucacaaugaaggagaaaucuuggcugguccauaagcaaugguuucuugaucugccguugcccuggacguccggcgcaucaaccagccaggaaacuuggaacaggcaggaccuccuggugacauucaaaaccgcucacgccaagaagcaagagguaguuguguuagguagucaggaaggggcuaugcacacagcccugacuggcgcaaccgagauucagacgucuggaaccacaacuauauuugccggccaucuaaaaugccggcucaagauggauaaacugacccuuaaggggacauccuaugucauguguacuggcagcuucaaauuggaaaaggagguggcugagacccagcacgguacgguccuggugcaaguuaaguacgaaggcacagacgcgccuugcaaaaucccauucucgacccaggaugagaagggggugacucagaauggacgucucauuacagcaaaccccaucguaaccgacaaagaaaagccugucaauauagagacugagccacccuuuggcgaaucuuauauugugguuggugccggggagaaagcucugaaacuuuccugguucaagaaaggcucaaguaucggaaagauguuugaagccaccgcacgcggcgccagaaggauggcuauccugggggauacagccugggacuucggaagcauugguggcguguuuacguccgucgggaaauuggugcaucagguauucggaaccgcauacggcgugcucuuuucugguguuagcuggacuaugaagaucgggauuggcauacuguuaacauggcugggacuaaacucacggaguaccucccucagcaugacauguaucgcggucggcauggugacucuguaccuuggggugaugguccaagcugauucuggaugcguuauuaauuggaaaggccgagaguugaagugugguucagggaucuucgugaccaacgaagugcacacguggacagagcaguauaaguuucaggccgacaguccgaaacgccugagcgcagccaucggaaaggcuugggaggaaggcguaugcgguauuagauccgccaccaggcucgagaacauaauguggaaacagaucucuaaugaacugaaccauauuuuacuggagaaugauaugaaguucacugucgugguuggcgacgcaaacgggauccuugcucaaggcaagaaaaugauucggccucagcccauggaacacaaauacucguggaaaagcuggggcaaggccaaaaucauaggggcggacauccagaauaccacauuuauuaucgauggaccagacacuccugagugucccgauaaccagcgcgccuggaauauuugggagguggaagacuauggcuucgguaucuuuaccacaaacauaugguugaagcucagagauuccuacacgcaaaugugcgaccacaggcugaugucagcugcaauuaaagauaguaaggccguccaugcugacaugggguauuggaucgagucugagaagaaugagaccuggaagcuagcccgugccagcuucauugaagugaagacuuguacauggccaaaaucccacacccuguggucaaacggaguucucgagagcgagaugaucauacccaagaucuacggcgguccuauuucucagcauaauuaucggccaggcuacuucacucagacagcggggccguggcaccugggaaaacuugaauuggauuuugaccugugcgagggcaccacggugguagucgaugaacacugcgggaaccgaggacccuccuuaagaacuaccacagugaccggcaagaucauucaugagugguguugcaggaguuguacucucccuccacugcgcuuccggggugaggacgggugcugguacggaauggaaaucagacccgugaaagagaaggaagagaaucuugucaggagcaugguuucugccggcuccggugaaguggauucauuuagucugggcauauuguguguaagcauuaugaucgaggaggugaugcgcucgcgauggucccggaagaugcucaugacagggacccuggucguguuccuacugcucaucaugggacaacugacauggaaagaccuuauucguuugugcaucaugguuggcgcuaacgccucugacagaauggggaugggaacuaccuaucuggcauuaauggcuacguuuaagaugaggccuauguucgccgugggccuccuguuucgccggcuuacaagcagagaaguccugcuacucaccauuggucugucauugguggcaaguguugagcugccaaauuccuuagaggaacucggggauggacuggccaugggcauaaugaugcuuaaacuguugacugaguuccagccccaccagcucuggaccacacugcuaucucugacuuuuaucaagaccacgcuuagccucgacuacgcuuggaaaacaaccgcgauggcccuguccauugugucauuguucccgcuguguuuaagcacuacaagucagaagaccacuuggcucccuguccugcuuggcucuuuugggugcaagccacugacaauguucuugaucaccgagaacaaaauuuggggaaggaaguccuggccccucaacgaggguaucauggcaauaggcaucguaagcauucugcuaucgucacugcuuaaaaaugaugugccucucgcugggccccugaucgccggaggcauguugauugccuguuauguuaucucugguaguuccgcugacuuaagccuggaaaaggcagccgaggugucuugggaacaagaggcggaacauagcgggacgucccacaacauacucgucgaggugcaggaugacggaacuaugaaaauuaaggaugaggaacgagacgauacccugacaauccuucugaaagcuaccuugcuagccguaucaggcguguacccaaugaguaucccugcaacacuguuugucugguauuucuggcagaagaagaaacagcgcagcggcguucucugggacacucccucuccaccggagguggaacgggccgugcuggaugacgggauuuacagaauacuucaaaggggauuacugggucguucccaggucggcguggggguuuuccaggauggaguauuucauaccauguggcacgugacgcgcggcgcuguccucauguaucaggguaagcgguuggagccuucaugggcaagugugaaaaaggaccugaucagcuacgggggaggcuggagauuccaaggcuccuggaauacaggggaggaaguucaggugauugccgucgagcccggcaagaacccaaagaaugugcagacuacccccgguacauuuaagaccccugaaggcgagguaggggcgaucgcucucgacuucaaaccaggaacuucuggcucgcccauugucaacagggaagguaagaucguggggcuguacggaaauggcguugugaccacaagcggcacguaugucucagccauagcacaagccaaggcuucccaggaggggccucuuccggagaucgaagaugagguguuuaagaaacgaaaccugacuauuauggacuugcacccaggaagugguaagacccggcgcuaccuacccgccaucguuagagaagcaauuaagaggaaacugcggacacucaucuuagcuccuacccgaguggucgccucugagauggcggaagcccugaagggcaugccaauaagauaucagacuacagcagugaaaagcgagcauaccgggcgcgagauuguagaucuuaugugccacgcuacguucacuaugaggcugcucucccccgugcguguuccuaauuacaacaugaucaucauggacgaagcccauuuuacagauccggcuucaauugcagcccggggauauaucucuaccagagucggcaugggugaggccgcugcgauauucaugaccgcaacucccccagggagcguggaagccuuuccucagaguaaugcugugauucaagacgaggaaagggauauccccgagcgcuccuggaacagcggauacgacuggauuacagauuucccaggcaagaccgucugguuuguaccuucuaucaaaucaggcaaugacauagccaacuguuugcgaaagaaugggaagagagugauucagcugucccggaaaacauucgauacugaguaucagaagacgaaaaacaacgacugggacuacguugugaccacagauaucagugaaaugggagcaaauuucagggccgaccgcgucaucgauccccguagaugccucaagccagugauucugaaagacgguccggagcggguuauccuugcuggcccuaugcccgugacugucgcgagcgccgcacagaggcgcgggcgaauuggaagaaaccaaaauaaggaaggcgaucaguacguguauaugggucagccacuaaacaaugacgaggaucacgcucauuggaccgaggccaagaugcuguuggacaacauaaauacacccgaagggaucauuccugcauuauuugagccagaacgggagaaaucggccgcuaucgauggcgaauacaggcugcgcggagaggccagaaagaccuucguagagcucaugaggcggggcgaccugcccguguggcuuucuuauaaaguugcguccgaaggguuucaguacagcgaucgucgcuggugcuucgacggagagcgaaacaaucaaguccuggaagagaacauggauguggaaaucuggacuaaggagggugagaggaagaagcucaggccucggugguuggacgcacgcacguauucagacccgcuggcccuaagagaauuuaaagaguucgcugccggcaggcggagugugucuggggaucugauucucgaaauaggaaaacuuccacagcaccugaccuuacgagcucagaaugcauuggacaaccuggucaugcuccacaauuccgagcagggcgguaaggccuacagacaugcuauggaagaacugcccgauacaaucgagacucuuaugcugcucgccuugauugcaguucugaccgggggcgugacauuauuuuuccuaagcggaaaaggccuggggaagaccucaaucggacuccuuuguguaacugcgaguagcgcccuguuguggauggcuuccguggaaccucacuggauugccgcaucuaucauacuggaguuuuuccucaugguccugcuuauccccgaaccagaccgccaaaggacaccucaggauaaccagcucgcuuaugugguuauuggucuguuguuuaugauccugacgguggccgcaaaugagaugggcuuacuagagaccacuaaaaaggaccuggggauuggacaugucgccgcugaaaaccaccaacacgcgacaaugcucgauguagaccuucggcccgccagcgcauggacccuguacgcuguggccaccacaguuaucacuccaaugaugcgucauacgauagagaacaccacagccaauauuuccuugacugcaaucgcuaaccaggccgcgauucugaugggccucgauaaagguuggccuaucucaaagauggacauaggggugccgcugcuugcuuuaggcugcuacucucaggucaauccccugacccucacagccgcaguguugaugcuggucgcccacuaugcuaucauuggaccaggccuacaggcaaaggccaccagagaagcgcagaagaggacugcugccgggaucaugaagaacccuacgguggauggaauuguugcaaucgaccuggaucccgugguauacgacgccaaauucgagaagcagcucggccagauaaugcuucugauuuuguguacaagucagauccugcucaugcgcaccacuugggcucugugcgaaucgaucaccuuagccacagguccacuuacuacccugugggaggggagcccuggaaaauuuuggaauacaacgauugcaguguccauggcuaacaucuuccggggcucuuaucucgccggugcgggccuagccuucucacugaugaaaagccuagggggaggccgaagagggaccggagcacaaggcgagacucugggugaaaaguggaaaaggcagcucaaucagcuuuccaagagugaguuuaacacauacaaacgcucugggauaauggaagucgaccgguucgaggcuaaggaaggacugaaaagaggcgagaccacuaagcaugccguuagccgugguacagcaaaguugaggugguuuguggagcggaaucuggucaaacccgaaggcaaggugauugaucucggguguggacgcggcggguggucauauuacugcgcuggacugaaaaagguaaccgaggugaaaggcuauacgaagggugggccgggacacgaagaaccaaucccuauggccaccuacggcuggaaccuaguuaaacuucauuccggcaaggacguguucuuuaugcccccagaaaagugugauacacugcuaugcgacauuggggagaguagccccaauccuacuaucgaggaaggacgaacccucagaguccugaaaaugguggagccgugguugagggguaaccaguucuguauaaagauccugaaucccuacaugccaucugucguggaaacacucgagcaaaugcagcggaaacacggcgggaugcuuguucgcaacccucuguccagaaauucaacucacgagauguauuggguaagcugcggaaccggcaacauugugucggccgucaauaugacaucuaggauguuacugaaccgauuuaccauggcgcaucggaagcccacuuacgaacgugauguggacuugggugcugggacgagacacguugcaguggagccugaagucgccaaccucgauaucauuggacagcgcaucgagaauauuaaaaacgaacauaagaguacauggcacuaugacgaggauaauccauacaagaccugggcuuaucacggcuccuacgaggugaaacccagcggcucagccuccucuaugguaaacggggugguuaagcugcuaacuaaaccuugggacgucaucccaauggugacccaaauagcaaugacagauacgacccccuucggacagcagaggguguuuaaggaaaaagucgacacucggacaccgagagccaagcgcgguaccacucagauuauggagguuacagcuaaguggcuuuggggcuuccugagcaggaauaaaaagccucgaaucuguacccgggaagaguuuacaagaaaagugaggaguaacgcggccaucggggcaguauucguggacgaaaaucaauggaacuccgcuaaggaggccgucgaggaugaacgcuuuugggaccucgugcaucgugagcgggaacugcacaaacagggaaagugcgcaacuugcguuuauaauaugaugggcaagagagagaaaaaguugggugaguucgggaaagccaagggaagcagggcuauuugguacauguggcugggcgcccgcuuccucgaguuugaggcgcuuggcuucaugaacgaagaucauugguuuucucgagaaaauucacugagugggguggaaggagaggguuuacacaaacugggcuacauauugcgggacaucuccaagauuccagggggaaacauguaugcagaugacaccgccggcugggauacgagaaucaccgaggacgaucuccagaaugaagcuaaaauuacagacaucauggagcccgaacaugcccugcuagcaacuagcauauucaaacuuaccuaccagaacaaggucgugaggguacaacgcccugcuaaaaaugguacaguuauggaugugaucucuagacgggaccagagggggucgggacaggucggcacuuauggccugaacaccuuuacgaacauggaggugcagcucauucgucaaauggaaucagaggggaucuuccugccaagcgaguuggaaacacccaauuuagccgagcgagugcuggauuggcucggaaagcacggugcugaacgccuuaaaagaauggccauuuccggcgacgacugugucguuaagccgaucgaugaccgguuugcaaccgcgcugacugcccuaaacgauauggggaaagugaggaaggacauaccucagugggagcccaguaagggauggaaugauuggcagcagguaccauucugcucucaccauuuucaccaacugauuaugaaagacggccgcgaaaucguggucccuuguagaaaccaggaugagcucgugggucgggcuaggguuagccagggggccggaugguccuugcgagagacagcaugccugggcaagucauacgcucaaauguggcagcuuauguauuuccaucguagagaccugcgccucgccaccaaugcaaaauguagugccgugcccgucgauugggugccaacuucucggaccacauggagcauccacgcgcaccaucaguggaugacgaccgaagacauguuauccguauggaacaggguuuggauugaggaaaaucccuggauggaggauaagacucacgugucaagcugggaagaggucccuuaccugggcaaaagagaggaccaguggugcgggucuuugauaggacugacagcucgcgccaccugggcaacuaacauccaaguggccauuaaucagguucggaggcucaucgguaacgaaaauuaucuugacuacaugacauccaugcgaagauuuaagaacgagagugauccagaaggcgcucugugguga

SEQ ID NO: 13416 - RNA, 9879 nt, Artificial Sequence
  derived and/or modified CDS sequence (opt3) from DENV-1__FJ024423__SS-prME
agcgugaccaugcugcucaugcuucugcccaccgcauuggcuuuccacuuaacuacgagaggaggggaaccucauaugaucgucuccaagcaggaaaggggaaaaucucugcuguuuaagaccucagccgguguuaauaugugcacacucauugccauggaccugggagaacuuugugaagauacuaugaccuacaaaugcccacaaauaaccgaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuguggcauuuuuccuggcccaugcuauuggcacaucgaucacccaaaagggcauuaucuuuauacucuuaaugcuggucacgccaucaauggccaugcggugcguggggaucggaaaucgcgauuucguagagggucuuagcggcgcgacuuggguugacguggucuuggagcacgggaguugugugacaaccauggcaaagaauaaacccacucuggauauugaacuacucaagacagaggugaccaacccugccauccugagaaaacuuugcauugaagcuaagaucuccaauacgaccacagacucuagguguccaacucagggagaggccacccuggucgaagaacaggaugcaaacuuuguuugccggcgcacauucguggaccgaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucaacaucagguggguaaugagacuacggaacacggcacaaucgccauuaucacaccccaggcgccuacuucagagauccagcucaccgacuacggggcccuuacacuggacuguaguccaagaaccggauuggauuuuaacgaaaugguccuacugacuaugaaggagaaaagcuggcucgugcauaagcaaugguuccuggaccuuccgcugcccuggacaucuggcgcauccacgucacaggagaccuggaauaggcaggauuugcucguaacuuuuaaaacagcucacgccaagaagcaagaaguugugguccuggguagccaggagggggcuaugcacaccgccuuaacaggcgcaacugaaauucagaccaguggaacgaccacaauauucgccggccaucugaaaugccggcuaaagauggacaaacucacucugaaggggaccucuuaugugauguguacaggauccuucaaacuugagaaggaagucgcugagacucagcacgguaccguguugguucaagugaaguacgagggcacggaugcgccuugcaaaaucccauuuagcacacaggacgaaaaggggguaacccagaacggacgucugauuacugcaaaucccaucgucacagauaaagagaagccugugaacauagaaaccgagccacccuucggcgagucguauauuguuaucggugccggggaaaaagcucucaagcugucuugguuuaagaaaggcuccucaaucggaaagauguucgaggccacugcacgcggcgccagaaggauggcuauucuuggggacaccgccugggauuuuggaaguaucgguggcguguucacaagcgucgggaaacuggugcaucagguauuuggaacggcauacggcguguuguucuccgguguuucuuggaccaugaagauugggauaggcauccuccugacuugguuaggacugaauagccggucaacaagucuauccaugaccuguauugcggucggcauggugacacucuaccugggggugaugguccaagcugacagcggaugcguuaucaacuggaaaggccgagaacuuaagugugguucugggaucuuugugacuaacgaggugcacaccuggacggaacaguauaaguuccaggccgauucaccgaaacgcuugagugcagccauuggaaaggcuugggaggagggcguaugcgguauaagaagcgccacaaggcuggaaaauaucauguggaaacagauuuccaacgagcucaaucauauccuguuagaaaacgacaugaaguuuaccgucgugguuggcgacgcaaaugggauucuggcucaaggcaagaagaugauccggccucagcccauggagcacaaauacucuuggaagucguggggcaaggccaaaauaaucggggcggauauucagaacacuaccuucaucauugacggaccagauacaccugaaugucccgacgaucagcgcgccuggaauaucugggagguggaggacuauggcuuugguauauucacuaccaacauuuggcuuaaguugagagauagcuacacacaaaugugcgaccacaggcucauguccgcugcaaucaaagauucaaaggccguccaugcugacaugggguauuggauugaaagugagaaaaaugaaacguggaagcuggcccgugcaucuuucaucgaggugaagaccuguacuuggccaaaaagccacacacuaugguccaacggaguucuggaaucagagaugauaauccccaagauuuacggcgguccuaucagccagcauaauuaucggccaggcuacuuuacccagacugcggggccguggcaccucggaaaacuggagcuugauuucgacuugugcgaaggcacaaccgugguagucgaugagcacugcgggaaccgaggacccucucugagaacgacuaccgugacaggcaagauuauccaugaaugguguugcagguccuguaccuuaccuccacuccgcuuucggggugaggacgggugcugguacggaauggagauaagacccgugaaagaaaaggaggaaaaucuggucaggaguaugguuagcgccggcucuggugagguggacuccuucucacuuggcauucugugugcuaguaucaugaucgaagagguaaugcgcagccgauggucgcggaagauguugaugacugggacacucgccguguuucugcuacugauuaugggacaacucaccuggaacgaucugauccgucuuugcauuauggucggcgcaaaugcuuccgacagaauggggaugggaacaacuuauuuggcccugauggcaaccuucaaaaugaggccuauguuugccgugggcuuacucuuccgccggcugacgucuagagagguucuucugcuaacaauaggucucagccugguggcuucagucgaauugccaaacagucuggaggaauuaggggauggacucgcgaugggcaucaugaugcugaaacuucugaccgaguuucagccccaccaguuguggacuacccuccugucccuaacauucauuaaaacuacccugucucuugacuacgccuggaagacgacagcaauggcucucagcaucgugucccuguuuccguugugucugucaaccacuagccagaaaacaaccugguuaccuguucuccugggcaguuucgggugcaagccacuuacuauguuucugauuacagaaaacaagaucuggggaaggaaaucuuggcccuugaaugaggguauaauggccaucggcauuguguccauccuccugagcucgcuacugaagaacgaugucccucuugccgggccccucauugcuggaggcaugcugaucgcauguuauguaauaucagguucuagugccgacuuguccuuagagaaagcggcugaagugagcugggagcaagaagccgagcauucugggaccagccacaauauucugguugaagugcaggaugacggaacgaugaagaucaaagaugaggagaaggacgauacucucaccauccugcuuaaagcaacacuguuggccgucuccggcguguacccaaugucaauuccugcuacccuauucguaugguauuucuggcagaagaagaaacagcgaaguggcgugcugugggacacacccagcccaccggaagucgagcgcgcaguucucgaugacgggauauaccggauccugcaaagaggacuuuuagguaggucucaggugggcgugggggucuuucaggacggaguguuccauacuauguggcacguuacccguggcgccguacugauguaucaggguaagcgccucgaaccuuccugggcgucagugaaaaaggauuugauuaguuacgggggaggcuggcgguuucaaggcagcuggaacacgggggaggagguccaggugaucgcuguugaacccggcaaaaauccaaagaacgugcagacaacucccgguaccuucaagacaccugagggcgaagucggggccauugcacuggacuuuaaaccaggaaccuccggcucucccaucgugaauagagaggguaagauaguagggcucuacggaaacggcgucgugacuaccucgggcacauauguuagcgccaucgcucaagccaaagcaucacaggaagggccucugccggagauugaggaugaaguguucaagaaaaggaaucuuacgaucauggaccugcacccaggauccgguaagacucgacgguacuugcccgcuauuguccgcgaggccaucaagagaaaacuaaggacccugauacucgcgccuacacgggugguugccagugaaauggcagaggcuuuaaagggcaugccaauucgauaucagaccacugccgugaaaucugaacauacagggagagagaucgucgaucugaugugccacgcuaccuuuacgaugcgccuucugagccccgugaggguaccuaacuacaauaugaucauuauggacgaggcacauuucacugauccggccuccaucgccgcucguggauauauaucaacacgggugggcaugggugaagcggcagccauuuuuaugaccgcuacacccccagggucuguugaggccuucccucagagcaacgcagucauccaagacgaagagagagauauucccgaaaggaguuggaacuccggauacgacuggaucacugauuuuccaggcaagacagugugguucgugccuagcauaaaaucuggcaacgacauugccaauugucuccgcaagaacgggaagcgagucauccaguugucaagaaaaaccuucgacacagaguaucagaagacuaaaaacaaugauugggacuacguagugacgaccgauaucuccgagaugggagcuaacuuucgggcggacaggguuauugauccccgccguugccugaagccagugauccucaaagacgguccggaaagagucauucuggccggcccuaugcccgugacaguugcaagugcugcccagcggagggggcgcauaggacgaaaucaaaacaaggagggcgaucaguacguguauaugggucagccacuuaauaacgacgaagaucacgcacauuggacugaggccaagaugcuacuggacaauaucaacacccccgaggggauuaucccugcuuuguucgaaccagagagagagaaaagcgccgcgaucgauggcgaguaccgguuaaggggagaagcacgcaagacauuugucgagcugaugagaaggggcgaccuccccguguggcugucguauaaaguagccucugagggguuccaguacuccgaucggcguuggugcuuugacggagaacgcaauaaccaagugcuugaggaaaauauggacguugagauuuggaccaaggaaggugagaggaaaaagcugagaccuagauggcucgaugcucggacuuauagcgacccguuggcccugcgcgaguucaaagaauuugcugcaggcagaaggucagucaguggggaucuaauacuggagaucggaaagcucccacagcaccuuacgcugcgggcccagaacgcuuuagacaauuuggugaugcugcacaacucugaacagggcgguaaggccuaccgacaugcaauggaggaacuccccgauaccauugagacacugaugcuucuggcgcucaucgccguguugacugggggcgucacccuguucuuuuuauccggaaaaggccuagggaagacaagcauuggacugcucuguguuaccgcuucaagugcccuucuguggauggcaagcguggagccucacuggaucgcugccuccauaaucuuggaguucuuucugaugguacuccugauucccgagccagacagacaacgcacuccucaggauaaucagcuugcauauguggucaucggucuccuguucaugauuuugacaguggccgcuaacgaaaugggccuguuagagacgaccaaaaaggaccuagggaucggacauguugcggccgagaaccaccaacacgcaacuaugcuggauguggaccucaggcccgcuucugccuggacacuuuacgccgucgcaaccaccguaauaacaccaaugaugcggcauacuauugaaaauacgaccgcuaacaucagccugacagccauugcgaaucaggcugccaucuugaugggccuggauaaagguuggccuauauccaagauggacaucggggugccgcuccuggcacuuggcugcuacucacagguuaaccccuuaacucugaccgccgcugugcucauguuggucgcacacuaugccauuaucggaccaggccugcaggcgaaggcuacacgugaggcccaaaaacgaaccgcagccgggauuaugaagaauccuacuguggauggaaucgucgcuauagaccuagaccccgugguuuacgaugccaaauuugaaaagcagcugggccagauuaugcuccuuauccuguguacgucucagaucuugcugaugaggacaaccugggcacucugcgagaguauuacucuggcuaccgguccauuaacaacucuuugggaagggucgccuggaaaauucuggaacaccacaaucgccgugagcauggcgaauauauuccgcggcuccuaucuggccggugcaggccucgcuuuuucucuaaugaagucacuagggggaggccggcgagggacgggagcccaaggcgagaccuugggugagaaguggaaaagacagcugaaccagcucagcaaguccgaguucaauacuuacaaaaggagugggauuauggagguagaccgcucugaagcaaaggagggacuuaaacggggcgaaacaaccaagcaugcugugagcagagguacugccaagcugcguugguuugucgagaggaacuugguuaaacccgagggcaaggugaucgaucugggguguggacggggcggguggucauauuacugcgccggacucaaaaaggucacagaagugaaaggcuauaccaagggugggccgggacacgaggaaccaauuccuauggcgacguacggcuggaauuuaguaaaacugcauuccggcaaggacguguucuuuaugcccccagagaagugugauacccuucugugcgacaucggggaaaguagccccaacccuacaauagaggagggacgcacucuacgaguucucaaaaugguggaaccguggcugagagguaaucaguucuguaucaagauuuugaaccccuacaugccaucugucguggagacccuggaacaaaugcagaggaaacacggcgggaugcucguccggaauccucuuucccgcaacucaacacacgagauguauugggugagcugcggaacuggcaauaucguuucggcuguaaacaugaccucuagaaugcuguuaaacagguuuacaauggcacaucgaaagcccaccuacgagcgggauguggaccugggugccgggacucgucacgucgcuguggaaccugagguugccaauuuggauauuaucggacagagaauugaaaacaucaaaaaugagcauaagaguacguggcacuaugacgaagauaacccauacaagacaugggcauaucacggcuccuacgaggugaaacccagcggcucagccuccucuauggucaauggggugguacgccuccugaccaagccuugggacgugauaccaaugguuacucaaauugcuaugaccgacacaacgcccuucggacagcagagggucuuuaaagagaagguggauacccggacuccgagagcgaaacgcgguacaacccagaucauggaagugacugccaaguggcuauggggcuuccuuagcaggaacaagaaaccucgaaucuguacacgggaggaauuuaccagaaaggucaggaguaaugcagcuauuggggccguuuucguggacgagaaccaauggaacuccgcaaaagaagccguagaggaugagcgcuuuugggaccuggugcaucgugaacgggagcuccacaagcagggaaaaugcgcuacaugcgucuauaacaugaugggcaagagagaaaagaaacugggugaguucgggaaggccaaaggaagcagggcgauaugguacaugugguugggcgcacgcuuccuggaauuugaggcccucggcuucaugaaugaggaucauugguuuucucgagaaaacucacuuagugggguggagggagaaggucugcacaaguuaggcuacauccugcgggacauuuccaaaaucccagggggaaauauguaugcugaugacacugccggcugggauaccagaauuacggaggacgauuugcagaacgaggcaaagaucaccgacauaauggaacccgagcaugcucuccuggccacaagcaucuucaaacuaacuuaccagaauaagguugugaggguccaacgcccugcuaagaacgguaccgugauggauguaauuucuagacgggaccagagggggucgggacagguuggcacauauggccuuaacacuuuuaccaauauggaagugcagcugauccgucaaauggagucagaagggauuuuccucccaagcgagcuggagacgcccaacuuggccaaacgagucuuagacuggcuggaaaagcacggagcagagcgccucaaaagaauggcgaucuccggugaugacuguguggugaagccgauagaugaccgguuugccacagcucuuaccgcccugaaugauaugggcaaagucaggaaggacauuccucagugggaacccaguaagggguggaacgauuggcagcagguuccauucugcucucaccauuuucaccaacuaaucaugaaagacggacgcgagaucgugguaccuuguagaaaucaggaugaacuggugggccgggcaagggucagccagggugcuggguggucccuccgagagacugccugcuugggaaagucauacgcacaaauguggcagcugauguauuuccaucguagagaccuucgccuggccgcgaacgcuauuuguagugccgugcccguugauugggugccaacaucucggaccacuuggagcauacacgcacaccaucaguggaugaccacagaggacaugcucuccgucuggaauaggguguggaucgaagagaaccccuggauggaagacaaaacgcacguaucaagcugggaggaaguuccuuacuuaggcaagagagaggaucaguggugcggcucucugauuggguugaccgcccgcgcuacuugggccacaaauauccaaguggcaauuaaccagguccggaggcugaucggaaaugagaacuaucucgacuacaugaccuccaugaaacgauuuaagaaugaaagugauccagagggugcucuuugguga

SEQ ID NO: 13417 - RNA, 9879 nt, Artificial Sequence
  derived and/or modified CDS sequence (opt3) from DENV-1__FJ547089__SS-prME
agcgugaccaugcugcucaugcuucugccaacagccuuggcuuuccacuuaacuacgaggggaggggaaccucauaugauagucuccaagcaggaaaggggaaaaucucuguuguuuaagaccucagccgguguuaacaugugcacacucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagacuauccaugaaugguguugcagguccuguacacucccuccacugcgcuuccggggugaggaugggugcugguacggaauggagauuagacccgugaaagaaaaggaggaaaaccuugucaggaguaugguuagcgccggcucuggugagguggacuccuuuucacugggcaucuugugugcuaguauaaugauugaagagguaaugcgcagccgauggucgcggaagaugcucaugaccgggacacuggccguguuccuacugcucaucaugggacaacugacuuggaaugaccuuauccguuugugcauuauggucggcgcaaacgcuuccgauagaauggggaugggaaccacguaucuggccuuaauggcaacauuuaaaaugaggccuauguucgccgugggccuccuguuucgccggcuuaccucuagagagguucugcuacucacuaucggucugagcuugguggcuucagucgaacugccaaacaguuuagaggaacucggggacggacuggcgaugggcauuaugaugcuuaagcuguugaccgaguuccagccccaccagcucuggacaacucugcuaucccugaccuuuauaaaaacgacacuuucucucgauuacgccuggaagaccacugcaauggcucugagcaucguguccuuguucccgcuguguuuaucaacaaccagccagaaaacuacauggcucccuguucugcuuggcaguuuugggugcaagccacugaccauguucuugauuacggaaaauaagaucuggggaaggaaaucuuggccccucaacgaggguauuauggccaucggcauaguguccauccugcuaagcucgcugcuuaagaaugacgucccucucgccgggccccugauugcuggaggcauguugaucgcauguuauguaauuucagguucuagugccgauuuaucccuggagaaagcggcugaagugagcugggagcaagaagccgagcauucugggacuagccacaacauccucguugaagugcaggacgauggaaccaugaagauaaaagacgaggagcgagaugacacacugaccauucuucugaaggcaacauugcuagccgucuccggcguguacccaaugucaaucccugcuacucuguuuguaugguauuucuggcagaaaaagaagcagcgcaguggcgugcucugggauacccccagcccaccggaagucgagcgggcaguucuggacgaugggaucuacaggauucuucaacgaggauuacugggucguucucaggugggcgugggggucuuccaggacggaguguuucauacgauguggcacguuacacgcggcgccguacucauguaucaggguaaacgguuggaaccuuccugggcgucagugaagaaagaccugauaaguuacgggggaggcuggagauuccaaggcagcuggaauacuggggaggagguccaggugaucgcuguugaacccggaaagaaccccaagaaugugcagaccacacccgguaccuuuaagacuccugagggcgaagucggggccauugcacucgauuucaagccaggaaccuccggcucucccaucgugaacagggaggguaaaauuguagggcuguacggaaauggcgucgugacaacgucgggcacuuauguuagcgccaucgcucaagccaaggcaucacaggaagggccucuuccggagauagaggacgaaguguuuaaaaagcgaaaccugaccaucauggauuugcacccaggauccgguaaaacacggcgcuaccuacccgcuauugucagagaggccaucaagaggaagcugcggacccucauuuuagcgccuacucgagugguugccagugaaauggcagaggcucugaaaggcaugccaaucagauaucagacaaccgccgugaagucugaacauacggggcgcgagauagucgaccuuaugugccacgcuacuuucacaaugaggcugcucagccccgugcguguaccuaauuacaacaugauuaucauggaugaggcacauuuuaccgacccggccuccaucgccgcucggggauauauuucaaccagagugggcaugggugaagcggcagccaucuucaugacugcuacacccccagggucuguugaggccuuuccucagagcaaugcagucauacaagaugaagagagggacauucccgaacgcaguuggaacuccggauacgauuggaucaccgacuucccaggcaaaacagugugguuugugccuagcauuaagucuggcaaugauaucgccaacuguuugagaaagaacgggaagagagucauacagcugucacggaagacuuucgacacggaguaucagaaaaccaagaauaacgacugggauuacguagugacaacugacauuuccgagaugggagcuaauuucagggcggaucgcguuaucgacccccguagaugccucaaaccagugauccugaaggaugguccggaacgggucauucuugccggcccuaugcccgugaccguugcaagugcugcccagaggcgcgggcgaaucggaagaaaccaaaauaaagagggcgaccaguacguguauaugggucagccacuaaacaaugaugaagaccacgcacauuggacagaggccaagaugcuguuggauaacauuaauacccccgaggggauaaucccugcuuuauuugaaccagagcgggaaaagagcgccgcgauugacggcgaguacaggcugcgcggagaagcaagaaaaacuuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacgaaagaaggugagagaaagaaacucaggccucggugguuggacgcucgcaccuauagcgauccgcuggcccuaagagaguuuaaggaguucgcugcaggcaggcggucagucaguggggaccugauccucgagauuggaaaacuuccacagcaccugacauuacgagcccagaaugcuuuggauaaccuggugaugcuccacaauucugaacagggcgguaaggccuacagacaugcaauggaggaacugcccgacacuauagagacccuuaugcugcucgcguugaucgccgugcugacagggggcgucaccuuauuuuuccuauccggaaagggccuggggaaaacuagcauuggacuccuuuguguuacagcuucaagugcccuguuguggauggcaagcguggagccucacuggaucgcugccuccauuauccuggaauuuuuccucaugguacugcuuauacccgagccagaucgccaaaggacgccucaggacaaccagcucgcauauguggucaucggucuguuguuuaugauucugaccguggccgcuaacgaaaugggcuuacuagagacuacaaagaaagaucuggggaucggacauguugcggccgagaaucaccaacacgcaaccaugcucgacguggaucuucggcccgcuucugccuggacccuguacgccgucgcaacaacuguaauuacgccaaugaugcgucauaccaucgaaaacacaacugcuaauaucagcuugaccgccauugcgaaccaggcugccauccugaugggccucgacaaggguuggccuauuuccaaaauggauaucggggugccgcugcuugcauuaggcugcuacucacagguuaauccccugacacucaccgccgcuguguugaugcuggucgcacacuaugccauaaucggaccaggccuacaggcgaaggcuacuagagaggcccaaaagaggacggcagccgggauuaugaaaaacccuacaguggacggaaucgucgcuauugaucuggaccccgugguuuacgacgccaaguucgaaaaacagcucggccagaucaugcuucugauauuguguaccucucagauucugcucaugcgcacuaccugggcacugugcgagaguaucacauuagcuacugguccacuuaccacacugugggaagggucgccuggaaaguuuuggaauacgaccaucgccgugagcauggcgaacauuuuccggggcuccuaucucgccggugcaggccuagcuuucucucugaugaaaucacuagggggaggccgaagagggacuggagcccaaggcgagacacugggugagaaguggaagaggcagcucaaucagcuuagcaaauccgaauuuaacaccuacaagcgcagugggaucauggagguagaucggucugaagcaaaagagggacugaagagaggcgaaacuacaaaacaugcugugagccgugguaccgccaaguugaggugguucgucgagcggaaucugguuaagcccgagggcaaagugauagaccucggguguggacgcggcggguggucauauuacugcgccggauuaaagaaagucacggaagugaagggcuauaccaaagguguaccggcgcgagaggaaccaauuccuauggcuacauacggguggaaccuggugaaacuucacuccggaaaagauguauuuuucaugcccccagagaagugugacacucugcuaugcgauaucggcgaaaguagccccaauccuaccauugaggagggcagaacacucagggugcugaagauggucgaaccgugguugcgggggaaccaguuuuguaucaaaauacugaaucccuacaugccaucuguggucgagacucucgaacaaaugcagcgcaagcauggagguaugcuugugagaaacccucuguccagaaauucaacccacgagauguauuggguuagcugcggcacagggaacaucguaucggcagugaacaugaccucucgaauguuacugaaucgguucacuauggcccaccguaaacccacguacgagagagacgucgauuugggagcuggcacacgccauguggccguugaaccugagguggcaaaccucgacauuaucggucagaggauugaaaauaucaagaacgagcacaaaaguaccuggcauuaugaugaagacaauccauacaagacuugggccuaucacggguccuacgaggucaagcccagcggaucagcuuccucuauggugaacggcguagugcggcugcuaaccaaaccuugggauguuauuccaauggucacacaaaucgcgaugacggacaccacucccuuuggccagcagagaguguucaaggagaaaguggacacacgcaccccgagggccaagcgagggacuacacagauaauggaagucaccgcaaaauggcuuuggggauuucugagccggaauaagaagccuagaauuuguacaagggaggaguucacucgcaaaguucguaguaacgcugccaucggugcaguguuuaucgaugagaaucaauggaacuccgccaaggaagcuguagaggacgagcgguucugggaucucgugcacagagaaagggagcugcauaaacagggcaagugcgcaaccugcgucuauaauaugauggggaaacgcgaaaagaaguugggagaguuuggcaaagcgaaggguagccgagcaauuugguacauguggcugggggcccgguuccucgaguucgaggcucuuggauuuaugaacgaggaccacugguucucuagagaaaauucacugaguggcguggagggcgaaggguuacauaaacugggauacauauugagggauaucuccaagauuccagguggcaacauguaugccgacgauacggcagggugggacacccgcguuacagaggaugaccuccagaaugaggcuaaaaucacugauauuauggaacccgagcacgcccugcuagcuaccagcaucuuuaaacuuacauaccagaacaaaguggucagagugcaacggccugccaagaacggaacuguaauggacguuauaucuaggcgugaucagcgaggcucgggucagguggggaccuauggacugaauacguucacaaacauggaaguccagcucauccgccaaauggagucagaaggcauuuuucugccaagcgaguuggagacccccaauuuagcagaaagagugcuggacuggcucgagaagcauggcgcggaacggcuuaggcgcauggccaucuccggggacgauuguguggucaaaccgauugacgauagauucgcuacugcccugacagcacuaaacgacaugggaaagguucggaaagauaucccucagugggagcccaguaaggguuggaaugacuggcaacaggugccauuuugcucucaccacuuccaucaacugauaaugaaagauggcagggaaauuguagugccuugucgaaaccaggacgagcucgucgggcgugcuagagugagccagggagccggcugguccuugcgcgagaccgcaugccuggguaagucauacgcccaaauguggcagcuuauguauuuucaccggagggaucugagacucgcggcuaaugccaucuguagugcaguucccguggacugggucccaacuucucgcaccacauggagcauccaugcccaccaccaguggaugacgaccgaagauauguuauccguguggaaccggguauggauugaggaaaaucccuggauggaggacaagacucauguuucaagcugggaagaggugccuuaccuggggaaaagggaggaccaguggugcggaucuuugauaggccugacagcucgagccaccugggcaacuaacauccaagucgcuauuaaucaggugagacggcucaucggcaacgaaaauuaucuugauuacaugacauccaugaagagguucaaaaacgagagugacccagaaggggcccugugguga

SEQ ID NO: 13418 - RNA, 9879 nt, Artificial Sequence
  derived and/or modified CDS sequence (opt3) from DENV-1__FJ024484__SS-prME
agcgugaccaugcugcucaugcuucugcccacugcauuggcuuuccacuuaacuacgagaggaggggaaccucauaugaucgucuccaagcaggaaaggggaaaaucucugcuguuuaagaccucagccgguguuaauaugugcacacucauugccauggaccugggagaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuguggcauuuuuccuggcccaugcuauuggcacaucgaucacccaaaagggcauuaucuuuauacucuuaaugcuggucacgccaucaauggccaugcggugcguggggaucggaaaccgcgauuucguagagggucuuagcggcgcgacuuggguugacguggucuuggagcacgggaguugugugacaaccauggcaaagaauaaacccacucuggauauugaacuacucaagacagaggugaccaacccugccauccugagaaaacuuugcauugaagcuaagaucuccaauacgaccacagacucuagguguccaacucagggagaggccacccuggucgaagaacaggaugcaaacuuuguuugccggcgcacauucguggaccgaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucaacaucagguggguaaugagacuacggaacacggcacaaucgccaccauuacuccccaggcgccuaccucagagauccagcucacagacuacggggcccuuacccuggacuguaguccaagaacuggauuggauuuuaacgaaaugguccuacugacaaugaaggagaaaagcuggcucgugcauaagcaaugguuccuggaccuuccgcugcccuggacgucuggcgcauccaccucacaggagacuuggaauaggcaggauuugcucguaacauuuaaaaccgcucacgccaagaagcaagaaguugugguccuggguagccaggagggggcuaugcacacagccuuaacuggcgcaaccgaaauccagacgaguggaaccacaacuauuuucgccggccaucugaaaugccggcuaaagauggacaaacucacccugaaggggacaucuuaugugauguguacuggauccuucaaacuugagaaggaagucgcugagacccagcacgguacgguguugguucaagugaaguacgagggcacagaugcgccuugcaaaauaccauuuagcacccaggacgaaaaggggguaacucagaacggacgucugaucacagcaaaucccauugucaccgauaaagagaagccugugaacaucgaaacugagccacccuucggcgagucguauauaguuauuggugccggggaaaaagcucucaagcugucuugguuuaagaaaggcuccucaaucggaaagauguucgaggccaccgcacgcggcgccagaaggauggcuauccuuggggacacagccugggauuuuggaaguauugguggcguguucacgagcgucgggaaacuggugcaucagguauuuggaaccgcauacggcguguuguucuccgguguuucuuggacuaugaagaucgggauuggcauacuccugacaugguuaggacugaauagccggucaaccagucuauccaugacauguaucgcggucggcauggugacucucuaccugggggugaugguccaagcugacagcggaugcguuauuaacuggaaaggccgagaacuuaagugugguucugggaucuuugugaccaacgaggugcacacguggacagaacaguauaaguuccaggccgauucaccgaaacgcuugagugcagccaucggaaaggcuugggaggagggcguaugcgguauuagaagcgccaccaggcuggaaaauauaauguggaaacagaucuccaacgagcucaaucauauucuguuagaaaacgacaugaaguuuacugucgugguuggcgacgcaaaugggauccuggcucaaggcaagaagaugauucggccucagcccauggagcacaaauacucuuggaagucguggggcaaggccaaaaucauaggggcggauauccagaacaccacauucauuaucgacggaccagauacuccugaaugucccgacgaucagcgcgccuggaauauuugggagguggaggacuauggcuuugguaucuucaccacaaacauauggcuuaaguugagagauagcuacacgcaaaugugcgaccacaggcucauguccgcugcaauuaaagauucaaaggccguccaugcugacaugggguauuggaucgaaagugagaaaaaugaaaccuggaagcuggcccgugcaucuuucauugaggugaagacuuguacauggccaaaaagccacacccuaugguccaacggaguucuggaaucagagaugaucauacccaagaucuacggcgguccuauuagccagcauaauuaucggccaggcuacuuuacucagacagcggggccguggcaccucggaaaacuggagcuugauuucgacuugugcgaaggcaccacggugguagucgaugagcacugcgggaaccgaggacccucucugagaacuaccacagugaccggcaagaucauucaugaaugguguugcagguccuguacuuuaccuccacuccgcuuucggggugaggacgggugcugguacggaauggagaucagacccgugaaagaaaaggaggaaaaucuggucaggaguaugguuagcgccggcucuggugagguggacuccuucucacuuggcauacugugugcuaguauuaugaucgaagagguaaugcgcagccgauggucgcggaagauguugaugacagggacccucgccguguuucugcuacugaucaugggacaacucacauggaacgaucugauucgucuuugcaucauggucggcgcaaaugcuuccgacagaauggggaugggaacuaccuauuuggcccugauggcaacguucaaaaugaggccuauguuugccgugggcuuacucuuccgccggcugacaucuagagagguucuucugcuaaccauuggucucagccugguggcuucagucgaauugccaaacagucuggaggaauuaggggauggacucgcgaugggcauaaugaugcugaaacuucugacugaguuucagccccaccaguuguggaccacacuccugucccuaacuuucaucaaaaccacgcugucucuugacuacgccuggaagacaaccgcaauggcucucagcauugugucccuguuuccguugugucugucaacuacaagccagaaaaccacuugguuaccuguucuccugggcaguuucgggugcaagccacuuacaauguuucugaucaccgaaaacaagauuuggggaaggaaaucuuggcccuugaaugaggguaucauggccauaggcaucguguccauucuccugagcucgcuacugaagaacgaugucccucuugccgggccccucaucgcuggaggcaugcugauugcauguuauguaaucucagguucuagugccgacuuguccuuagagaaagcggcugaagugagcugggagcaagaagccgagcauucugggacgagccacaauauacugguugaagugcaggaugacggaacuaugaagauuaaagaugaggagaaggacgauacccucacaauccugcuuaaagcaacccuguuggccgucuccggcguguacccaaugucaaucccugcuacacuauucguaugguauuucuggcagaagaagaaacagcgaaguggcgugcugugggacacucccagcccaccggaagucgagcgcgcaguucucgaugacgggauuuaccggauacugcaaagaggacuuuuagguaggucucaggugggcgugggggucuuucaggacggaguguuccauaccauguggcacguuacgcguggcgccguacugauguaucaggguaagcgccucgaaccuuccugggcgucagugaaaaaggauuugaucaguuacgggggaggcuggcgguuucaaggcagcuggaacacaggggaggagguccaggugauugcuguugaacccggcaaaaauccaaagaacgugcagacuacccccgguacauucaagaccccugagggcgaagucggggccaucgcacuggacuuuaaaccaggaacuuccggcucucccauugugaauagagaggguaagaucguagggcucuacggaaacggcgucgugaccacaucgggcacguauguuagcgccauagcucaagccaaagcaucacaggaagggccucugccggagaucgaggaugaaguguucaagaaaaggaaucuuacuauuauggaccugcacccaggauccgguaagacccgacgguacuugcccgcuaucguccgcgaggccauuaagagaaaacuaaggacacugauccucgcgccuacccgggugguugccagugaaauggcagaggcuuuaaagggcaugccaauacgauaucagacuacagccgugaaaucugaacauaccgggagagagauugucgaucugaugugccacgcuacguuuacuaugcgccuucugagccccgugaggguaccuaacuacaauaugaucaucauggacgaggcacauuucacagauccggccuccauugccgcucguggauauaucucaacccgggugggcaugggugaagcggcagccauauuuaugaccgcuacucccccagggucuguugaggccuucccucagagcaacgcagucauucaagacgaagagagagauauccccgaaaggaguuggaacuccggauacgacuggauuacagauuuuccaggcaagaccgugugguucgugccuagcaucaaaucuggcaacgacauagccaauugucuccgcaagaacgggaagcgagucauucaguugucaagaaaaacauucgacacugaguaucagaagacgaaaaacaaugauugggacuacguagugaccacagauaucuccgagaugggagcuaacuuucgggcggccaggguuaucgacccccgccguugccugaagccagugauucucaaagaugguccggaaagagucauccuggcaggcccuaugcccgugacuguugcuagugccgcacagcggagggggcgcauuggacgaaaucaaaacaaggagggcgaccaguacguguauaugggucagccacuuaauaacgaugaagaccacgcccauuggaccgaggcuaagaugcuacuggauaauauaaacacacccgaggggaucauuccugccuuguucgaaccagagagagagaaaagcgcggcaaucgacggcgaguaccgguuaaggggagaagcccgcaagaccuuugucgagcugaugagaaggggcgaucuccccguguggcugucguauaaaguagcuucugagggguuccaguacuccgaccggcguuggugcuuugauggagaacgcaauaaccaagugcuugaggaaaauauggacguugagaucuggacuaaggaaggugagaggaaaaagcugagaccuagauggcucgacgcccggacguauagcgauccguuggcucugcgcgaguucaaagaauuugcagccggcagaaggucagucaguggggaccuaauucuggagauaggaaagcucccacagcaccuuacccugcgggcucagaacgccuuagauaauuuggugaugcugcacaacucugaacagggcgguaaggcauaccgacaugcgauggaggaacuccccgacacaaucgagacucugaugcuucuggcccucauugcuguguugaccgggggcgucacacuguucuuuuuauccggaaaaggccuagggaagaccagcaucggacugcucuguguuacugccucaagugcacuucuguggauggcuagcguggagccucacuggauugccgcauccaucauauuggaguucuuucugaugguacuccugauccccgagccagauagacaacgcacaccucaggacaaucagcuugccuauguggucauuggucuccuguucaugaucuugacgguggcugcgaacgaaaugggccuguuagagaccacuaaaaaggaucuagggauuggacauguugccgcagagaaccaccaacacgcuacaaugcuggacguggaucucaggcccgccucugccuggacccuuuacgcagucgcuaccacaguaaucacuccaaugaugcggcauacgauagaaaauaccacagccaacauuagccugacugcgaucgcuaaucaggccgcaauuuugaugggccuggacaaagguuggccuaucuccaagauggauauaggggugccgcuccuggcccuuggcugcuacucacagguuaaccccuuaacccugacagcugcagugcucauguuggucgcccacuaugcgaucauuggaccaggccugcaggcuaaggccacccgugaggcacaaaaacgaacugccgcugggaucaugaagaauccuacgguggacggaauugucgccaucgaucuagaccccgugguuuacgacgcaaaauuugaaaagcagcugggccagauaaugcuccuuauucuguguacaucucagaucuugcugaugaggaccacuugggcucucugcgagaguaucacccuggccacagguccauuaacuacccuuugggaagggucgccuggaaaauucuggaacacaacgauugcggugagcauggccaauaucuuccgcggcuccuaucuggccggugcuggccucgccuuuucucuaaugaagucacuagggggaggccggcgagggaccggagcacaaggcgagacuuugggugagaaguggaaaagacagcugaaccagcucacaaagagcgaguucaauaccuacaaaagguccgggauaauggagguagaucgcagugaagcuaaggagggacuuaaacggggcgaaacuacaaagcaugccgugucuagagguaccgccaagcugcguugguuugucgagaggaacuugguuaaacccgagggcaaggugauugaccugggguguggacggggcggguggagcuauuacugcgcgggacucaaaaaggucacggaagugaaaggcuauaccaagggugggccgggacacgaggaaccaaucccuauggcuacauacggcuggaauuuaguaaaacugcauucaggcaaggauggguucuuuaugcccccagagaaguguggaacucuucugugcgacauuggugaauccagucccaacccuaccaucgaggagggccgcacacuacgagugcucaaaaugguugaaccguggcugagagggaaucaguucuguauaaagaucuugaaccccuacaugccaagcguggucgagacucuggaacaaaugcagaggaaacacggaggcaugcucgugcggaauccucuuucucgcaacuccacccacgagauguauugggucucaugcgguacagggaauauugugagcgcaguuaacaugaccucgagaaugcuguuaaacagguuuacuauggcccaucgaaagcccacguacgagcgggauguagaccugggagcuggcacacgucacguggccgucgaaccugagguggcaaauuuggauaucauuggccagagaaucgaaaacauuaaaaaugagcauaagucuaccuggcacuaugacgaagauaacccauacaagacuugggccuaucacgggaguuacgagguuaaacccuccggaagcgcuucauccauggugaauggugucgugcgccuccugaccaagccuugggacguaaucccaauggugacacaaauagcgaugacggauaccacucccuucggccagcagaggguuuuuaaagagaaggucgacacacggaccccgagagccaaacgcgggacuacacagauuauggaagugaccgcaaaguggcuauggggauuccuuucuaggaacaagaaaccucgaaucuguacacgggaggaauuuacuagaaaggugaggagcaaugcugccaucggcgcagucuucguugacgagaaccaauggaauagugccaaagaagcuguggaggaugagcgcuuuugggaccugguacaucgugaacgggagcuccacaagcaggguaaaugcgcaaccugcguguauaacaugauggggaagagagaaaagaaacugggagaguucggcaaggcgaaaggcuccagggcaauuugguacaugugguugggggcccgcuuccuggaauuugaggcucucggauucaugaaugaggaucauugguuuagccgagaaaacucucuuucaggugucgagggcgaagggcugcacaaguuaggauacauacugcgggacaucaguaaaauuccaggcgguaauauguaugccgaugacacggcagggugggauaccagaaucacagaggacgauuugcagaacgaggcuaagauuacugacaucauggaacccgagcaugcccuccuggcuaccuccauauucaaacuaacauaccagaauaaggugguuagggugcaacgcccugccaagaacggaacugucauggaugugaucagcagacgggaccagaggggcucuggccagguagggaccuauggacuuaacacguuuacaaauauggaaguucagcugauucgucaaauggagucggaagguaucuuccucccaucagagcuggagacccccaacuuggcaaaacgaguguuagauuggcuggaaaagcacggcgcggagcgccucaaaagaauggccauuagcggggacgacugugucgugaagccgaucgaugaccgguuugcuacugcccuuacagcacugaaugauaugggaaaagugaggaaggacauaccucagugggaacccuccaagggcuggaacgauuggcagcaggucccauucugcagucaccauuuucaccaacuaauuaugaaagacggucgcgagaucguugugccuuguagaaaucaggaugaacugguagggcgggcuagggugucucagggagccggcuggagccuccgagagaccgcaugcuugggcaaguccuacgcccaaauguggcagcugauguauuuccaucguagagaccuucgccuggcggcuaacgccaucuguucagcaguccccguggauuggguuccaacaagucggaccacauggucuauucacgcccaccaucaguggaugacgaccgaggacaugcucagcguguggaauagggucuggauagaagagaaccccuggauggaagauaaaacucacguguccucaugggaggaaguaccuuacuuagggaagagagaggaccaguggugcggaagccugaucgguuugacagcucgcgccaccugggcaacuaauauucaaguugcuaucaaccaggugcggaggcugauuggcaaugagaacuaucucgacuacaugacaucuaugaaacgauuuaagaaugaauccgauccagagggggcccuuugguga

SEQ ID NO: 13419 - RNA, 9879 nt, Artificial Sequence
  derived and/or modified CDS sequence (opt3) from DENV-1__EU596503__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguaucggauccuucaaauuggagaaggaaguggcugagacucagcacgguaccguccuggugcaaguuaaguacgagggcacggaugcgccuugcaaaauuccauucagcacacaggacgaaaagggggugacccagaacggacgucucaucacugcaaaucccauaguaacagauaaagagaagccugucaacauugaaaccgagccacccuuuggcgagucguauaucgugguuggugccggggaaaaagcucugaagcuuucuugguucaagaaaggcuccucaaucggaaagauguuugaggccacugcacgcggcgccagaaggauggcuauucugggggacaccgccugggauuucggaaguaucgguggcauguuuacaagcguggggaaauugguccaucagguguucggaacggcauacggcguacucuuuuccggugugucuuggaccaugaagauugggauaggcauccuguuaacuuggcugggacuaaauagccggucaacaagucucuccaugaccuguauugcgguuggcauggucacacuguaccuuggggugauggugcaagcugacagcggaugcgucaucaacuggaaaggccgagaauugaagugugguucugggaucuucguuacuaacgaggugcacaccuggacggaacaguauaaguuucaggccgauucaccgaaacgccugagugcagccauuggaaaggcuugggaggagggcgugugcgguauaagaagcgccacaaggcucgaaaauaucauguggaaacagauuuccaacgagcugaaucauaucuuacuggaaaacgacaugaaguucaccguagucgugggcgacgcaaaugggauucuugcucaaggaaaaaagaugauccggccucagcccauggagcacaaauacucuuggaagucguggggcaaggccaaaauaaucggggcggauauucagaacacuaccuuuaucauugacggaccagauacaccugaaugucccgacaaucagcgcgccuggaacaucugggagguugaggauuauggcuucgguauauuuacuaccaauauuugguugaagcucagagacagcuacacacaaaugugcgaucacaggcugauguccgcugcaaucaaagacucaaaggccgugcaugcugauaugggguauuggauugaaagugagaaaaacgaaacguggaagcuagcccgugcaucuuucaucgaggucaagaccuguacuuggccaaaaagccacacacugugguccaauggagugcucgaaucagagaugauaauccccaagauuuacggcgguccuaucagccagcauaacuaucggccaggcuacuucacccagacugcggggccguggcaccugggaaaacuugaguuggacuuugaucugugcgaaggcacaaccguugugguagacgagcacugcgggaaucgaggacccucuuuaagaacgacuaccgucacaggcaagauuauccaugaaugguguugcagguccuguacccucccuccacugcgcuuccggggugaggaugggugcugguacggaauggagauaagacccgugaaagaaaaggaggaaaaccuugugaggaguauggucagcgccggcucuggugagguugacuccuuuucacugggcauuuugugugcuaguaucaugaucgaagaggugaugcgcagccgauggucgcggaagaugcucaugacugggacacuggccguauuccuacugcucauuaccggacaacugacauggaaugaccuuauccguuugugcauuauggugggcgcaaacgcuuccgauagaauggggaugggaacuaccuaucuggccuuaauggcaacguuuaaaaugaggccuauguucgccgucggccuccuguuucgccggcuuacaucuagagaggugcugcuacucaccauaggucugagcuugguugcuucaguggaacugccaaacaguuuagaggaacucggggacggacuggcgaugggcaucaugaugcuuaagcuguugacugaguuccagccccaccagcucuggaccacacugcuaucccugacuuuuauuaaaaccacgcuuucucucgauuacgccuggaagacaaccgcaauggcucugagcaucgucuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauaauggccaucggcauuguuuccauccugcuaagcucgcugcuuaagaaugacgugccucucgccgggccccugauugcuggaggcauguugaucgcauguuaugucauaucagguucuagugccgauuuaucccuggagaaagcggcugaaguaagcugggagcaagaagccgagcauucugggacgagccacaacauucucguggaaguucaggacgauggaacuaugaagaucaaagacgaggagcgagaugacacccugacaauccuucugaaggcaaccuugcuagccguguccggcgucuacccaaugucaauuccugcuacacuguuugugugguauuucuggcagaaaaagaagcagcgcaguggcguacucugggauacucccagcccaccggaaguggagcgggcaguccuggacgaugggauauacagaauccuucaaaggggauuacugggucguucucagguuggcguggggguguuccaggacggagucuuucauaccauguggcacgugacgcgcggcgccguucucauguaucaggguaaacgguuggaaccuuccugggcgucaguaaagaaagaccugauuaguuacgggggaggcuggagauuccaaggcagcuggaauacaggggaggaggugcaggucaucgcuguggaacccggaaagaacccaaaaaauguucagacuacccccgguacauuuaagaccccugagggcgaagugggggccauugcacucgauuucaagccaggaacuuccggcucucccaucgucaacagggaggguaaaauaguggggcuguacggaaauggcguagucaccacaucgggcacguaugugagcgccaucgcucaagccaaggcaucacaggaagggccucuuccggagauugaggacgaaguuuuuaaaaagcgaaaccugacuaucauggauuugcacccaggauccgguaaaacccggcgcuaccuacccgcuauugugagagaggccaucaagaggaagcugcggacacucauauuagcgccuacccgagucguggccagugaaauggcagaggcucugaaaggcaugccaauuagauaucagacuacagccguuaagucugaacauaccgggcgcgagaucguggaccuuaugugccacgcuacguucacuaugaggcugcucagccccguccgugugccuaauuacaacaugaucauuauggaugaggcacauuuuacagacccggccuccaucgccgcucggggauauauaucaaccagaguaggcaugggugaagcggcagccauuuucaugaccgcuacucccccagggucuguggaggccuuuccucagagcaaugcaguuauccaagaugaagagagggacauucccgaacgcaguuggaacuccggauacgauuggaucacagacuucccaggcaaaaccgucugguuugugccuagcauaaagucuggcaaugauauugccaacuguuugcgaaaaaacgggaagagagugauccagcugucacggaagacauucgacacugaguaucagaaaacgaagaauaacgacugggauuacgucguaaccacagacaucuccgagaugggagcuaauuucagggcggaucgcgugauugacccccguagaugccucaaaccaguuauccugaaggaugguccggaacgggugauucuugccggcccuaugcccgucacuguggcaagugcugcccagaggcgcgggcgaauaggaagaaaccaaaauaaagagggcgaccaguacguuuauaugggucagccacuaaacaaugaugaagaccacgcacauuggaccgaggccaagaugcuguuggauaacaucaauacacccgaggggauuaucccugcuuuauuugaaccagagcgggaaaagagcgccgcgaucgacggcgaguacaggcugcgcggagaagcaagaaaaaccuucguggagcucaugaggcggggcgaucugcccgucuggcuuucguauaagguggccucugagggguuucaguacuccgaccgucgcuggugcuucgauggagaacgaaacaaucaaguacuggaggaaaacauggacguggagauuuggacuaaagaaggugagagaaagaaacucaggccucggugguuggacgcucgcacguauagcgauccgcuggcccuaagagaguuuaaggaauucgcugcaggcaggcggucaguuaguggggaccugauacucgagaucggaaaacuuccacagcaccugaccuuacgagcccagaaugcuuuggauaaccuggucaugcuccacaauucugaacagggcgguaaggccuacagacaugcaauggaggaacugcccgacacaauugagacucuuaugcugcucgcguugaucgccgugcugaccgggggcgugacauuauuuuuccuauccggaaagggccuggggaaaaccagcauuggacuccuuugugucacugcuucaagugcccuguuguggauggcaagcguugagccucacuggaucgcugccuccauaauccuggaauuuuuccucauggugcugcuuauucccgagccagaucgccaaaggacaccucaggacaaccagcucgcauauguagugaucggucuguuguuuaugauucugacggucgccgcuaacgaaaugggcuuacuagagaccacuaagaaagaucuggggaucggacauguggcggccgagaaucaccaacacgcaacaaugcucgacguugaucuucggcccgcuucugccuggacccuguacgccguggcaaccacagucauaacuccaaugaugcgucauacgauugaaaacaccacagcuaauaucagcuugacugccauugcgaaccaggcugccauccugaugggccucgacaaggguuggccuauauccaaaauggauaucgggguaccgcugcuugcauuaggcugcuacucacaggugaauccccugacccucacagccgcuguuuugaugcugguggcacacuaugccauuaucggaccaggccuacaggcgaaggcuaccagagaggcccaaaagaggacugcagccgggauuaugaaaaacccuacggucgacggaaucguggcuauagaucuggaccccgucguguacgacgccaaguucgaaaaacagcucggccagauuaugcuucugaucuuguguacaucucagauccugcucaugcgcaccacuugggcacugugcgagaguauuaccuuagcuacagguccacuuacuacccugugggaagggucgccuggaaaguuuuggaauacaacgaucgccguuagcauggcgaacauauuccggggcuccuaucucgccggugcaggccuagcuuucucucugaugaaaucauuggggggaggccgaagagggaccggagcccaaggcgagacucugggugagaaguggaagaggcagcucaaucagcuuagcaaauccgaauuuaacacauacaagcgcagugggauuauggagguggaucggucugaagcaaaagagggacugaagagaggcgaaaccacuaaacaugcuguaagccgugguacagccaaguugaggugguucguggagcggaaucuggucaagcccgagggcaaaguuaucgaccucggguguggacgcggcggguggucauauuacugcgccggauuaaagaaagugaccgaagucaagggcuauacgaaaggugggccgggacacgaggaaccaauuccuauggcgaccuacggcuggaaccuggugaagcuucauuccggcaaagauguauuuuucaugcccccagagaagugugacacacugcuaugcgauaucggggaaaguagccccaauccuacuauagaggagggacgaacccucagagugcugaagaugguugaaccgugguugagggguaaccaguuuuguaucaaaauucugaaucccuacaugccaucuguggucgagacacucgaacaaaugcagcggaagcacggcgggaugcuugugcgcaacccucuguccagaaauucaacucacgagauguauugggucagcugcggaaccggcaacaucgugucggcuguuaacaugacaucuaggauguuacugaaucgauucaccauggcacaucggaaacccacuuacgagcgugacguagauuugggugccgggacgagacacguggcugucgaaccugagguggccaaccucgacauuaucggacagcgcauugaaaauaucaagaacgagcauaaaaguacauggcacuaugaugaagacaauccauacaagaccugggcauaucacggcuccuacgagguuaagcccagcggcucagccuccucuauggugaacggggucgugaggcugcuaacuaaaccuugggauguaauaccaauggugacccaaauugcuaugacagacacgacccccuuuggacagcagcggguuuucaaggagaaagucgacacuagaacaccgcgcgcgaagagggguaccacucagaucauggaagugacagccaaauggcuuuggggcuuucugagccgaaauaagaagccucggaucuguaccagagaggaauucacaaggaaagugcgcaguaacgcagcuauuggggccgucuuuguugaugagaaucaauggaacuccgcaaaggaagccguggaggacgagcguuucugggaucucguacaucgggaaagagagcugcacaaacagggaaagugcgcuacuugcguguauaauaugaugggcaaaagggaaaagaaguugggugaguuugggaaagccaagggaagccgcgcgauaugguacauguggcugggcgcacgauuccucgaauucgaggcccuuggcuuuaugaacgaggaccauugguucucucgggaaaauucacugaguggggucgagggagaagguuuacacaaacugggcuacaucuugagagauauuuccaagaucccagggggaaacauguaugcugacgauaccgccggcugggacacgaggauuaccgaggaugaccuccagaaugaggcaaaaaucacagauauaauggaacccgagcaugcucugcuagccacuagcaucuuuaagcuuaccuaccagaacaaagugguucgcgugcaaagaccugcuaagaacgguacagucauggacgugauuucucggagggaucagcgugggucgggacagguaggcacuuauggccugaauaccuucacgaacauggaaguucagcucauccgacaaauggagucagaagggauuuuucugccaagcgaguuggagacacccaauuuagccgaacgcgugcuggacuggcucgagaagcacggagcagaaagacuuaaacggauggcgaucuccggugacgauugugucgugaagccgauagacgauagguucgccaccgcucugacugcccuaaacgacaugggcaaagugcgcaaggauauuccucagugggagcccaguaaaggguggaaugacuggcagcaggucccauuuugcucucaccauuuccaccaacugaucaugaaggauggaagagaaaucguugugccuugucggaaccaggacgagcucguaggcagggcacgagugagccagggugcugggugguccuugcgugagacagccugccugggaaagucauacgcacaaauguggcagcuuauguauuuucauagacgcgaucugcggcucgccgcgaaugcuauuuguagugccguccccguggacuggguuccaaccucuaggacuaccuggagcauacacgcacaccaucaguggaugacaacggaagauauguuauccguguggaacagagucuggaucgaggaaaaucccuggauggaggacaaaacccacgugucaagcugggaagagguaccuuaccugggcaagcgcgaggaccaguggugcggcucuuugauugggcugacugcccgggcuacaugggccaccaacauccaaguugcaauuaaucaggugaggcgacucaucggaaacgaaaauuaucuugauuacaugacuuccaugaaaagauucaagaacgagagugacccagaaggugcucugugguga

SEQ ID NO: 13420 - RNA, 9879 nt, Artificial Sequence
  derived and/or modified CDS sequence (opt3) from DENV-1__FJ024479__SS-prME
agcgugaccaugcugcucaugcuucugcccacugcauuggcuuuccacuuaacuacgagaggaggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacagauaaccgaagcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagcggguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucggauuuuucaccacaaauaucugguugaagcucagagacagcuacacgcaaaugugcgaucacaggcugauguccgcugcaauaaaagacucaaaggccguccaugcugauaugggguauuggauugaaagugagaaaaacgaaaccuggaagcuagcccgugcaucuuucaucgaggugaagacuuguacauggccaaaaagccacacccugugguccaauggaguucucgaaucagagaugauuauccccaagauauacggcgguccuaucagccagcauaacuaucggccaggcuacuuuacucagacagcggggccguggcaccugggaaaacuugaguuggacuucgaucugugcgaaggcaccacggugguagucgacgagcacugcgggaaucgaggacccucuuuaagaacuaccacagugaccggcaagauuauccaugaaugguguugcagguccuguacucucccuccacugcgcuuucggggugaggaugggugcugguacggaauggagauuagacccgugaaagaaaaggaggaaaaccuugucaggaguaugguuagcgccggcucuggugagguggacuccuucucacugggcaucuugugugcuaguauaaugauugaagagguaaugcgcagccgauggucgcggaagaugcucaugacagggacccuggccguguuucuacugcucaucaugggacaacugacauggaaugaccuuauccguuugugcauuauggucggcgcaaacgcuuccgauagaauggggaugggaacuaccuaucuggccuuaauggcaacguucaaaaugaggccuauguuugccgugggccuccuguuccgccggcuuacaucuagagagguucugcuacucaccaucggucugagcuugguggcuucagucgaacugccaaacaguuuagaggaacucggggacggacuggcgaugggcauuaugaugcuuaagcuguugacugaguuucagccccaccagcucuggaccacacugcuaucccugacuuucauaaaaaccacgcuuucucucgauuacgccuggaagacagcagcuauggcccugagcaucguguccuuguuuccgcuguguuuaucaaccacuagccagaaaacaaccuggcucccuguucugcuuggcaguuucgggugcaagccacugacuauguuuuugauuacagaaaauaagaucuggggaaggaaaucuuggccccucaacgaggguauuauggccaucggcauaguguccauccugcuaagcucgcugcuuaagaaugacgucccucucgcugggccccugauugcaggaggcauguugaucgccuguuauguaauuucagguucuagugcggauuuaucccuggagaaagcugccgaagugagcugggagcaagaagcagagcauucugggaccagccacaacauccucguugaagugcaggacgauggaacgaugaagauaaaagacgaggagcgagaugacacucugaccauucuucugaaggccacauugcuagcugucuccggcguguacccaaugucaaucccugcaacccuguucguaugguauuucuggcagaaaaagaagcagcgcaguggcgugcucugggauacacccagcccaccggaagucgagcgggccguucuggacgaugggaucuacaggauucuucaacgaggauuacugggucguucucaggugggcgugggggucuuucaggacggaguguuccauacuauguggcacguuacccgcggcgcgguacucauguaucaggguaaacgguuggaaccuuccugggcuucagugaagaaagaccugauaaguuacgggggaggcuggagauuucaaggcagcuggaauacgggggaggagguccaggugaucgccguugaacccggaaagaaccccaagaaugugcagacaacucccgguaccuucaagacaccugagggcgaagucggggcaauugcccucgauuuuaagccaggaaccuccggcucucccaucgugaacagggaggguaaaauuguagggcuguacggaaauggcgucgugacuaccucgggcacauauguuagcgcuaucgcccaagcaaaggcuucacaggaagggccucuuccggagauagaggacgaaguguucaaaaagcgaaaccugacgaucauggauuugcacccaggauccgguaaaacucggcgcuaccuacccgccauugucagagaggcgaucaagaggaagcugcggacccucauuuuagccccuacacgagugguugcaagugaaauggcugaggcccugaaaggcaugccaaucagauaucagaccacugcugugaagucugaacauacagggcgcgagauagucgaccuuaugugccacgcaaccuuuacgaugaggcugcucagccccgugcguguaccuaauuacaacaugauuaucauggaugaggcccauuucacugacccggccuccaucgcugcgcggggauauauuucaacaagagugggcaugggugaagcagccgcuaucuuuaugaccgccacacccccagggucuguugaggcauucccucagagcaaugccgucauacaagaugaagagagggacauucccgaacgcaguuggaacuccggauacgauuggaucacugacuuuccaggcaaaacagugugguucgugccuagcauuaagucuggcaaugauaucgcuaacuguuugagaaagaacgggaaaagagucauacagcugucacggaagaccuucgacacagaguaucagaaaacuaagaauaacgacugggauuacguagugacgaccgacauuuccgagaugggagcgaauuuuagggccgcacgcguuaucgauccccguagaugccucaaaccagugauccugaaggacgguccggaacgggucauucuugcuggcccuaugcccgugacaguugccagugcagcccagaggcgcgggcgaaucggaagaaaccaaaauaaagagggcgaucaguacguguauaugggucagccacuaaacaaugacgaagaucacgcucauuggacugaggccaagaugcuguuggacaacauuaccacacccgaggggauaaucccugcguuauucgaaccagagcgggaaaagagcgcagccauugauggcgagucgaggcugcgcggagaacccagaaaaaccuuugucgagcucaugaggcggggcgaccugccuguguggcuuucuuacaagguagcuuccgagggguuccaguauagcgaucgucgcuggugcuuugacggagaacgaaauaaccaagugcuggaggaaaauauggauguugagaucuggccgaaagaaggugagagaaagaaacucaggccacggugguuggacgcccgcacuuacucagacccccuggcucuaggcgaguucaaggaauuuggggcaggaagaaggaguggcucuggugcccugauccucgagauugggaaacuuccucagcaucugccauuacgggcucagaacggcuuggauaaucuggucauggugcacaacuccgaacagggaggcaaggccuaucgacacgcaauggaggaacucccagacacgauagagacccugaugcuucuggcgcucaucgccguguugacagggggagucacucuguucuuuuuaagcgguaagggccuagggaaaaccucaauuggacugcucuguguuacagcuaguagcgcccuucuguggauggcauccguggagccucacuggaucgcugccucuauuaucuuggaguucuuucugaugguacuccugauacccgagccagauagacaacgcaccccucaggacaaucagcuugcauacguggucaucggccuccuguucaugauuuugacuguggccgcuaacgaaaugggucuguuagagacaacgaagaaagaucuagggaucggccauguugcggccgagaaccaccaacacgcaaccaugcuggacguggaucucaggccggcuagcgccuggacucuuuaugccgucgcaacaaccguaauuacccccaugaugcggcauacaaucgaaaauacuacggcuaacauaucccugaccgccauugcgaaucaggcugccaucuugaugggacuggcaaagggcuggccaauuucaaaaauggacaucggggugccucuccuggcccuuggaugcuacucucagguuaaccccuuaacacugacugcugcagugcucauguuggucgcccacuacgcgauaaucggcccaggucugcaggcuaaggccacccgugaggcacaaaagagaacagccgcugggauuaugaaaaauccuaccguggauggaaucgucgccauugaccuagaucccgugguuuaugacgcaaaguuugaaaaacagcugggccagaucaugcuccuuauacuguggacgagucagauuuugcugaugaggacuacaugggcucucggugagucgaucacccuggccacuggcccguuaaccacacuuugggaagggagcccaggaaaguucuggaacacuaccaucgcgguguccauggccaauauuuuccgcggcucuuaccuggcaggggcuggacucgccuuuucacuaaugaaaagccugggcggugggcggcgaggaacaggcgcacaaggugagacguugggcgagaaguggaagagacagcugaaccagcucuccaaaagugaguucaauaccuauaagaggucugggaucauggagguagaucgcagcgaagcuaaagagggacuuaagcggggcgaaacuacaaaacaugccgugucaagagggaccgccaagcugcguugguuugucgagaggaacuugguuaauccugagggaaaggugauagaccugggcugugguagaggggguugguccuacuauugcgcgggccucaaaaaggucacugaagugaaaggcuacacaaaagggggacccggucacgaggaaccaauucccauggcuaccuauggcuggaacuuaguaaaacugcauagugggaaggacguguucuuuaucccuccggagaaaugugauacgcuucugugcgacauuggagaaagcucucccaauccaaccaucgaggagggccgcacacuacgaggucucaagaugguugaaccuuggcugagagggaaccaguucuguauaaagaucuugaaucccuacaugccuuccguggucgagacucuggaacaaaugcagaggaaacacggaggcaugcucgugcggaacccacuuucacgcaauagcacccacgagauggauugggucucgugcggcacagggaacauugugucugcaguuaacaugacaaguagaaugcuguuaaauagguuuaccauggcccaucgaaagcccacauacgagcgggacguagaucugggagcugguacccgucacguggccgucgaaccugagguggcaaacuuggacaucauuggccagagaaucgaaaauauuaaaaacgagcauaaguccacuuggcacuaugaugaagacaauccauacaaaacgugggccuaucacgggagcuacgagguuaagcccucaggauccgcuucuagcauggugaacggcgucgugcgccuccugacaaagccgugggauguaaucccuauggugacccaaauagcgaugacugacaccacaccauucggucagcagaggguuuuuaaagagaaggucgauacgcggacccccagagccaaacgcgggacuacacagauuauggaagugaccgcaaaguggcuauggggauuccuuaguaggaauaaaaagccucgaaucuguacucgggaggaauuuacaagaaaggugagguccaacgcugccaucggcgcagucguuguggacgagaaucaauggaacagcgccaaagaagcuggcgaggacgagcgcguaugggaucugggggaccgugaacgggagcuccauaagcagggaaaaugcgccaccugugguuauaauaugaugggcaagagagagaaaaagcugggggaguucggaaaggcgaaaggcucuagggcaauuugguacaugugguugggugcccgcuuucuggaguucgaggcucucggguucaugaacgaggaucacugguuuucacgagaaaauagucuuuccggaguggagggcgaaggccugcauaaguuaggguauauacugcgggacaucagcaaaauuccaggagguaacauguacgccgaugacacagcaggcugggauacuagaaucaccgaggacgauuugcagaaugaggcuaagauuacggacaucauggaacccgagcacgcccuccuggcuaccucuauauucaaacuaacauaccagaacaaggucgugaggguucaacgcccggccaaaaacgggacugugauggaugucaucucgagacgggcacagaggggaucaggccagguggguaccuaugggcuuaauacauuuacuaacauggaaguacagcugauucgucaaauggagagcgaaggaaucuuccucccuuccgagcuggagacccccaauuuggcggaacgaguuuuagacuggcuggagaagcauggcgccgaacgccucaagagaauggcuauuaguggcgaugacugcguggucaaaccaaucgacgaucgguuugccacggcacuuacagcucugaacgacauggggaaggugaggaaagauauaccucagugggagcccucuaagggauggaaugacuggcaacagguggccuucuggagccaccacuuucaucaacuaauuaugaaagauggucgcgaaaucgucguuccaugcagaaaccaggacgagcugggcgggcgggcaagggugucccagggagccggcuggucacuccgagagaccgcguguuuggguaagaguuacgcucaaauguggcagcugauguauuuccaccguagagaucuucgccuggccgcaaaugccaucugcucugcuguacccguggacugggucccuacuagccggacaaccugguccauucaugcccaccaccaguggaugacuaccgaagauaugcucucaguguggaacaggguuuggauagaggaaaauccauggauggaggacaagacacaugugagcucuugggaagaggucccguacuuagggaaaagagaggaucagugguguggaucccugaucggcuugacggcacgcgcuaccugggccacuaacauucaaguggcgaucaaucagguacggaggcugauuggcaacgaaaauuaucucgacuacaugacaaguaugaagcgauuuaaaaacgagagcgaccccgaaggggcucuuugguga
